US012698469B2

(12) United States Patent
David et al.

(10) Patent No.: US 12,698,469 B2
(45) Date of Patent: Aug. 4, 2026

(54) FUNGAL CELLS FOR TAILORED FATS

(71) Applicant: MELT & MARBLE AB, Gothenburg (SE)

(72) Inventors: Florian David, Gothenburg (SE); Paulo Alexandre Goncalves Teixeira, Gothenburg (SE); Anastasia Krivoruchko, Gothenburg (SE)

(73) Assignee: MELT & MARBLE AB, Gothenburg (SE)

( * ) Notice: Subject to any disclaimer, the term of this patent is extended or adjusted under 35 U.S.C. 154(b) by 413 days.

(21) Appl. No.: 18/257,305

(22) PCT Filed: Dec. 21, 2021

(86) PCT No.: PCT/SE2021/051297
§ 371 (c)(1),
(2) Date: Jun. 14, 2023

(87) PCT Pub. No.: WO2022/139668
PCT Pub. Date: Jun. 30, 2022

(65) Prior Publication Data
US 2024/0043788 A1 Feb. 8, 2024

(30) Foreign Application Priority Data
Dec. 22, 2020 (SE) .................................... 2051552-4

(51) Int. Cl.
*C12N 1/185* (2026.01)
*C12N 9/10* (2006.01)
*C12N 9/20* (2006.01)
*C12P 7/6409* (2022.01)
*C12R 1/85* (2006.01)

(52) U.S. Cl.
CPC ........... *C12N 1/185* (2021.05); *C12N 9/1029* (2013.01); *C12N 9/20* (2013.01); *C12P 7/6409* (2013.01); *C12R 2001/85* (2021.05); *C12Y 301/01003* (2013.01)

(58) Field of Classification Search
CPC ................................. C12P 7/6463; C12N 1/12
See application file for complete search history.

(56) References Cited

U.S. PATENT DOCUMENTS

| | | | |
|---|---|---|---|
| 2017/0369910 A1* | 12/2017 | Tsakraklides | ......... C12P 7/6463 |
| 2019/0382780 A1 | 12/2019 | Cahoon et al. | |
| 2020/0392470 A1 | 12/2020 | Moseley et al. | |

FOREIGN PATENT DOCUMENTS

| | | |
|---|---|---|
| WO | 2013126076 A1 | 8/2013 |
| WO | 2016044336 A1 | 3/2016 |

OTHER PUBLICATIONS

International Search Report and Written Opinion corresponding to International Application No. PCT/SE2021/051297, mailed Jul. 21, 2022 (24 pages).
Bates, Philip D., "Understanding the control of acyl flux through the lipid metabolic network of plant oil biosynthesis", Biochimica et Biophysica Acta, 2016, 1214-1225.
Bergenholm, David, et al., "Modulation of saturation and chain length of fatty acids in *Saccharomyces cerevisiae* for production of cocoa butter-like lipids", Biotechnology and Bioengineering, vol. 115, No. 4, 2018, 932-942.
Budziszewski, G.J., et al., "Uses of Biotechnology in Modifying Plant Lipids", Lipids, vol. 31, No. 6, 1996, 557-569.
Moharana, Tushar Ranjan, et al., "Substrate structure and computation guided engineering of a lipase for omega-3 fatty acid selectivity", PLOS ONE 15(4): e0231177, 2020.
Song, Xin, et al., "Studies of substrate specificities of lipases from different sources", European Journal of Lipid Science Technology, 110, 2008, 1095-1101.
Van Erp, Harrie, et al., "Engineering the stereoisomeric structure of seed oil to mimic human milk fat", PNAS, vol. 116, No. 42, 2019, 20947-20952.
Wei, Yongjun, et al., "Increasing cocoa butter-like lipid production of *Saccharomyces cerevisiae* by expression of selected cocoa genes", AMB Express, 7:34, 2017.
Xin, Yi, et al., "Biosynthesis of Triacylglycerol Molecules with a Tailored PUFA Profile in Industrial Microalgae", 9 Molecular Plant, 2019, 474-488.

* cited by examiner

*Primary Examiner* — Tekchand Saidha
(74) *Attorney, Agent, or Firm* — Myers Bigel, P.A.

(57) ABSTRACT

The present invention generally related to a fungal cell capable of tailored triacylglycerols. The fungal cell comprises at least one modification to the endogenous fatty acid metabolism.

6 Claims, 14 Drawing Sheets

Specification includes a Sequence Listing.

FUNGAL CELLS FOR TAILORED FATS

TECHNICAL FIELD

The present invention relates generally to fungal cells for production of tailored fats, and in particular to such fungal cells capable of producing selected triacylglycerol species.

BACKGROUND

Triacylglycerols (TAGs) are esters of glycerol with three fatty acids. TAGs are the main constituent of animal and vegetable fats and oils. TAGs have numerous commercial applications, including in food, personal care, and oil paints and coatings. Current technologies for producing TAGs are typically via extraction from plant or animal sources, such as coconut, palm, palm kernel, tallow and lard. However, there are concerns over the sustainability of these sources. Furthermore, it is of interest to produce TAGs of specific structures and composition in order to get desired properties. For example, new trends at producing sustainable plant-based alternatives to animal foods, such as plant-based meat and dairy, require fats that are similar to animal fats in order to mimic the taste and texture of animal food products. This is, however, difficult to do with plant-based fats, which typically produce very different TAG structures.

Within TAGs, each of the three carbons in the glycerol molecule allows for a stereochemically distinct fatty acid bond position: sn-1, sn-2, and sn-3. The types of fatty acids and their stereospecificity in TAG species determine the properties and physical behaviour of TAGs. For example, quality specifications, such as 'mouth feel' in chocolate or ice-cream, and the 'lightness' of pastry are dependent on melting point and crystallisation properties of fats. In order to obtain TAGs with optimal properties, it is of interest to "tailor-make" TAG species by dictating which fatty acids are assembled into the TAG and onto which position they are assembled. Furthermore, due to increasing concerns over sustainability, it is of interest to find new and sustainable sources of TAGs.

Microbial fermentation provides an ideal solution to this issue. Recent advances in genetic and metabolic engineering have allowed for precise manipulation of the microbial metabolism to produce tailor-made products. This can be achieved, for example, by increasing production of certain fatty acids over others, as well as expressing specific TAG assembly enzymes that position fatty acids at specific positions. Other advantages of microbial production include better a sustainability profile, environmental friendliness, scalability, geographical independence, and cost effectiveness. For example, metabolic engineering of the yeast *Saccharomyces cerevisiae* has enabled the production of cocoa butter-like lipids (Bergenholm D et al., 2018). However, better methods are still needed to more precisely tailor the TAG composition within microbial fats.

SUMMARY

A general objective of the present invention is to provide a fungal cell capable of producing selected TAG species, thereby obtaining a fungal cell for tailored fats production.

The present invention is defined in the independent claims. Further embodiments of the invention are defined in the dependent claims.

The present invention allows production of selected TAG species in fungal cells and thereby enables such fungal cells to be used for producing tailored fats. The genetic modifications of the invention results in expression of TAG assembly enzymes that assemble desired fatty acids onto TAG molecules optionally combined with overexpression of a TAG lipase that removes undesired fatty acids from TAG molecules. The result is a fungal cell with a higher proportion of desired TAG species.

BRIEF DESCRIPTION OF THE DRAWINGS

The embodiments, together with further objects and advantages thereof, may best be understood by making reference to the following description taken together with the accompanying drawings, in which.

DETAILED DESCRIPTION

Figure 1:
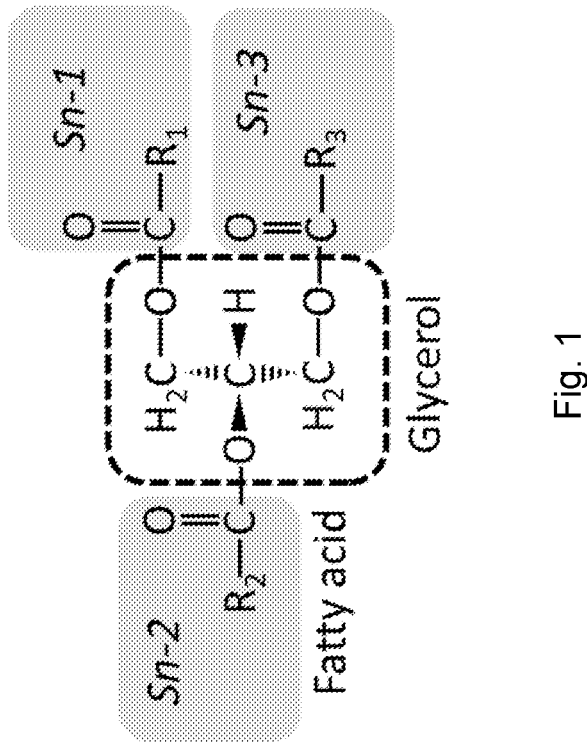
FIG. 1. Structure of a triacylglycerol (TAG) and stereo-chemical numbering, sn-1, sn-2, and sn-3.

The present invention now will be described hereinafter with reference to the accompanying drawings and examples, in which embodiments of the invention are shown. This description is not intended to be a detailed catalogue of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined herein, scientific and technical terms used herein will have the meanings that are commonly understood by those of ordinary skill in the art.

Generally, nomenclatures used in connection with techniques of biochemistry, enzymology, molecular and cellular biology, microbiology, genetics and protein and nucleic acid chemistry and hybridization, described herein, are those well-known and commonly used in the art.

Conventional methods and techniques mentioned herein are explained in more detail, for example, in Molecular Cloning, a laboratory manual [second edition] Sambrook et al. Cold Spring Harbor Laboratory, 1989, for example in Sections 1.21 "Extraction And Purification Of Plasmid DNA", 1.53 "Strategies For Cloning In Plasmid Vectors", 1.85 "Identification Of Bacterial Colonies That Contain Recombinant Plasmids", 6 "Gel Electrophoresis Of DNA", 14 "In vitro Amplification Of DNA By The Polymerase Chain Reaction", and 17 "Expression Of Cloned Genes In *Escherichia coli*" thereof.

Enzyme Commission (EC) numbers (also called "classes" herein), referred to throughout this specification, are according to the Nomenclature Committee of the International Union of Biochemistry and Molecular Biology (NC-IUBMB) in its resource "Enzyme Nomenclature" (1992, including Supplements 6-17) available, for example, as "Enzyme nomenclature 1992: recommendations of the Nomenclature Committee of the International Union of Biochemistry and Molecular Biology on the nomenclature and classification of enzymes", Webb, E. C. (1992), San Diego: Published for the International Union of Biochemistry and Molecular Biology by Academic Press (ISBN 0-12-227164-5). This is a numerical classification scheme based on the chemical reactions catalyzed by each enzyme class.

All publications, patent applications, patents and other references cited herein are incorporated by reference in their entireties for the teachings relevant to the sentence and/or paragraph in which the reference is presented.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

Throughout the description and claims of this specification, the words "comprise" and "contain" and variations of the words, for example "comprising" and "comprises", mean "including but not limited to" and do not exclude other moieties, additives, components, integers or steps. Throughout the description and claims of this specification, the singular encompasses the plural unless the context otherwise requires. In particular, where the indefinite article is used, the specification is to be understood as contemplating plurality as well as singularity, unless the context requires otherwise.

To facilitate understanding of the invention, a number of terms are defined below.

As used herein, the term "fatty acid" refers to a carboxylic acid with a long aliphatic chain, composed of 4 to 40 carbons, which is either saturated or unsaturated. An unsaturated fatty acid contains at least one double or triple bond within its aliphatic chain, which can occur at any position. Typically unsaturated fatty acids with a single double bond within the aliphatic chain are referred to as "monounsaturated", while unsaturated fatty acids with two or more double bonds within their aliphatic chain are referred to as "polyunsaturated". To define the position of the double bond, the delta-x (delta(x) or Δ-x) nomenclature is used herein. In this nomenclature, each double bond is indicated by "delta(x)", where the double bond is located on the $x^{th}$ carbon-carbon bond, counting from the carboxylic acid end. A fatty acid can be either straight-chained or have branches, i.e., with one or more alkyl groups, such as methyl groups, on the carbon chain. Furthermore, a fatty acid can have additional modifications, such as hydroxylation, i.e., a hydroxy fatty acid, epoxidation, i.e., an epoxy fatty acid and/or comprise multiple, i.e., at least two, carboxylic groups, such as a dicarboxylic fatty acid. Within the cell, fatty acids can occur as free fatty acids (FFAs), fatty acyl-CoAs, fatty acyl-acyl carrier proteins (ACPs), fatty acids within triacylglycerols (TAGs), fatty acids within steryl esters, or fatty acids within phospholipids. Fatty acids can have an even or an odd number of carbons. The most common fatty acids in fungal cells, including yeast, include oleic acid (abbreviated herein as "0"), palmitic acid (abbreviated herein as "P"), palmitoleic acid (abbreviated herein as "Po") and stearic acid (abbreviated herein as "S"). Examples of additional saturated fatty acids include, but not limited to, butyric acid (abbreviated herein as "Bu"), hexanoic acid (abbreviated herein as "H"), caprylic acid (abbreviated herein as "Cy"), capric acid (abbreviated herein as "C"), lauric acid (abbreviated herein as "La"), myristic acid (abbreviated herein as "M"), arachidic acid (abbreviated herein as "A"), behenic acid (abbreviated herein as "B"), ligoceric acid, cerotic acid, montanic acid, melissic acid, lacceroic acid, geddic acid, hexatriacontylic acid, octatriacontylic acid, and tetracontylic acid. Examples of additional unsaturated fatty acids can include, but are not limited to, myristoleic acid (abbreviated herein as "Mo"), sapienic acid, elaidic acid, vaccenic acid, gadoleic acid, eicosenoic acid, erucic acid, nervonic acid, linoleic acid (abbreviated herein as "L"), eicosadienoic acid, docosadienoic acid, α-linolenic acid (abbreviated herein as "Ln"), γ-linolenic acid, pinolenic acid, α-eleostearic acid, β-eleostearic acid, mead acid, dihomo-γ-linolenic acid, eicosatrienoic acid, stearidonic acid, arachidonic acid, eicosatetraenoic acid, adrenic acid, bosseopentaenoic acid, eicosapentaenoic acid, docosapentaenoic acid, tetracosanolpentaenoic acid, docosahexaenoic acid.

As used herein, the terms "fatty acyl-CoA" or "acyl-CoA", refer to a fatty acid that is bound to coenzyme A (CoA). Within the cell, fatty acyl-CoAs are often used as fatty acid donors for different reactions.

As used herein, the term "saturated" when referring to acyl-CoA or fatty acyl-CoA, refers to an acyl-CoA, in which the fatty acid does not have any double or triple bonds. Examples of saturated acyl-CoAs include, but are not limited to, palmitoyl-CoA (palmitic acid bound to CoA) and stearoyl-CoA (stearic acid bound to CoA).

As used herein, the term "unsaturated" when referring to acyl-CoA or fatty acyl-CoA, refers to an acyl-CoA, in which the fatty acid has at least one double bond. Examples of unsaturated acyl-CoAs include, but are not limited to, palmitoleoyl-CoA (palmitoleic acid bound to CoA) and oleoyl-CoA (oleic acid bound to CoA).

As used herein, the term "short-chain fatty acid" refers to fatty acids having 10 carbons or less. Examples of common short-chain fatty acids include, but are not limited to, butyric acid (4 carbons), hexanoic acid (also known as caproic acid; 6 carbons), caprylic acid (also known as octanoic acid; 8 carbons), and capric acid (also know as decanoic acid; 10 carbons). Similarly, the term "short-chain fatty acyl-CoA" or "short-chain acyl-CoA" refers to a fatty acid bound to CoA, wherein the fatty acid has 10 carbons or less.

As used herein, the term "medium-chain fatty acid" refers to fatty acids with of 12 to 14 carbons. Examples of common medium-chain fatty acids include but are not limited to lauric acid (12 carbons), myristic acid (14 carbons), and myristoleic acid (14 carbons). Similarly, the term "medium-chain fatty acyl-CoA" or "medium-chain acyl-CoA" refers to a fatty acid bound to CoA, wherein the fatty acid has 12 to 14 carbons.

As used herein, the term "long-chain fatty acid" refers to fatty acids having 16 to 18 carbons. Examples of common long-chain fatty acids include but are not limited to palmitic acid (16 carbons), palmitoleic acid (16 carbons), oleic acid (18 carbons), and stearic acid (18 carbons). Similarly, the term "long-chain fatty acyl-CoA" or "long-chain acyl-CoA" refers to a fatty acid bound to CoA, wherein the fatty acid has 16-18 carbons.

As used herein, the term "very long-chain fatty acid" refers to fatty acids having 20 carbons or longer. Examples of common long-chain fatty acids include but are not limited to arachidic acid (20 carbons), behenic acid (22 carbons), and nervonic acid (24 carbons). Similarly, the term "very long-chain fatty acyl-CoA" or "very long-chain acyl-CoA" refers to a fatty acid bound to CoA, wherein the fatty acid is 20 carbons or longer.

As used herein, the terms "triacylglycerol", "TAG", "triacylglyceride", and "triglyceride" refer to a tri-ester of glycerol bound to three fatty acid molecules. TAGs are the chief constituents of fats and oils. In TAGs, the hydroxyl groups of the glycerol join the carboxyl groups of the fatty acid to form ester bonds, see FIG. 1. The fatty acids in a TAG can be identical or different. The physical and chemical properties of the TAG are determined by the specific fatty acids, e.g., chain length and unsaturation, esterified to the glycerol moiety and the actual position the fatty acids occupy. Each of the three carbons in the glycerol molecule allows for a stereochemically distinct fatty acid bond position: sn-1, sn-2, and sn-3. The orientation of the TAG structure stereospecificity is as follows: if the fatty acid esterified to the middle carbon of the glycerol backbone is considered to the left (on the plane of the page, see FIG. 1), then the top carbon is numbered sn-1, the bottom carbon is numbered sn-3 (below or behind the plane of the page) and the middle carbon is numbered subsequently as sn-2 (FIG. 1). TAGs can contain a variety of fatty acids, but most commonly contain oleic acid, palmitic acid, stearic acid, and palmitoleic acid.

The terms "TAG species" or "TAG molecular species" when referring to TAGs, refers to a TAG molecule of defined fatty acid composition and arrangement on the glycerol backbone. Two TAG molecules that are chemically identical molecular entities can be said to be the same TAG species. Typically TAGs within cells are composed of many different TAG species. To be considered the same TAG species, two TAG molecules must contain identical fatty acids, in identical abundance, and in identical positions (sn-1, sn-2 or sn-3) on the glycerol backbone. For example, a TAG molecule containing the fatty acids oleic acid (sn-1), oleic acid (sn-2) and palmitoleic acid (sn-3) is a distinct TAG species from a TAG molecule containing the fatty acids oleic acid (sn-1), palmitoleic acid (sn-2), and palmitoleic acid (sn-3), since both the abundance of specific fatty acids (the first TAG molecule has 2 oleic acid and 1 palmitoleic acid, while the second TAG molecule has 1 oleic acid and 2 palmitoleic acids) and the positioning of fatty acids (the first TAG molecule has oleic acid in position sn-2, while the second TAG molecule has palmitoleic acid in position sn-2) are different. In a further example, a TAG molecule containing palmitic acid (sn-1), oleic acid (sn-2), and oleic (sn-3), is a distinct TAG species from a TAG molecule containing oleic acid (sn-1), palmitic acid (sn-2), and oleic acid (sn-3). This is because even though both TAG molecules contain the same fatty acids and at the same abundance, the positioning of the fatty acids are different in each TAG molecule, resulting in different properties. Furthermore, a TAG molecule containing palmitic acid (sn-1), oleic acid (sn-2), and oleic (sn-3) is a distinct TAG species from a TAG molecule containing oleic acid (sn-1), oleic acid (sn-2), and palmitic acid (sn-3).

TAG species can be abbreviated based on the fatty acids they contain and the positioning of these fatty acids. For example a TAG containing palmitic acid (sn-1), oleic acid (sn-2), and oleic acid (sn-3) can be abbreviated as POO. In a further example, a TAG containing palmitic acid (sn-1), palmitoleic acid (sn-2), and palmitoleic acid (sn-3) can be abbreviated as PPoPo. Examples of TAG species include, but are not limited to, PPP, PPO, POP, POO, OPO, PPS, PSP, PSS, SPS, PPPo, PPoP, PPoPo, POS, PSO, OPS, POPo, PPoO, PSPo, PPoS, PoPPo, OOO, SOO, SSO, OSO, SOS, OOPo, OPoO, OPoPo, OSPo, OPoS, PoOS, PoOPo, SSS, SSPo, SpoS, PoSPo, PoPoPo, PoPoS, OPoO, BOB, BOO, OBO, BBB, AOA, AOO, OAO, AAA, POL, PoHO, MOP, PLO, MPO, PPL, SOL, MPS, MSS, MOO, LLL, OOPo, LOO, PMS, OPL, PSL, PLP, OLO, LLO, LLP. PoOL, PPoL, OLnL, OLnO, PPBu, OPBu, OOBu, PMBu, OPLa, PPC, PMCy, SMBu, BuOM, MMC, PBuL, MOCy, POCy, PCC, SOBu, PPC, CCO, MOH, OOCy, HLaO, MMBu, PLaBu, MLaH, PCH, MCCy and LaCC.

As used herein, the term "tailored" or "tailor-made" when referring to TAGs and fats, refer to fats containing TAG species tailored for specific nutritional value, health benefits, sensory characteristics or other performance characteristics. One can create tailored fats by modifying the fatty acid contents within TAGs, modifying how fatty acids are assembled on different positions (sn-1, sn-2, sn-3) within specific TAG species, as well as increasing or decreasing the presence of specific TAG species within the fat mixture.

As used herein, the term "lipase" refers to an enzyme that catalyzes the hydrolysis of fats and the term "triacylglycerol lipase" or "TAG lipase" refers to a lipase that hydrolyses ester linkages of TAGs and has EC number EC 3.1.1.3. TAG lipases cleave the TAG at the acyl chain, releasing the fatty acids within the TAGs. TAG lipases can target fatty acids of different positions on the TAG molecule. For example, some TAG lipases might target fatty acids at all positions, while other TAG lipases might have preference for sn-1, sn-2 or sn-3 positions. In some cases TAG lipases have a preference for the sn-1 and sn-3 positions over the sn-2 position. In addition, TAG lipases may have preference for the types of substrates they target, with some preferring TAGs containing unsaturated fatty acids, thereby releasing unsaturated fatty acids upon hydrolysis, while other preferring TAGs containing saturated fatty acids. The terms "triacylglycerol lipase" and "TAG lipase" as used herein encompass an enzyme having TAG lipase activity, i.e., is capable of hydrolysing ester linkages of triacylglycerols. This might be an enzyme primarily described as a TAG lipase, or another type of enzyme that displays TAG lipase activity.

As used herein, the term "glycerol-3-phosphate acyltransferase" or "GPAT" (also known as "glycerol-3-phosphate O-acyltransferase") (EC 2.3.1.15) refers to an enzyme that catalyzes the condensation of acyl-CoA and glycerol-3-phosphate to 1-acyl-sn-glycerol-3-phosphate, releasing CoA. This is the first step in TAG assembly, placing the fatty acid in the sn-1 position. 1-acyl-sn-glycerol 3-phosphate is also sometimes referred to as "lysophosphatidic acid" or "LPA".

As used herein, the term "lysophosphatidyl acyltransferase" or "LPAT" (also known as "1-acyl-sn-glycerol-3-phosphate acyltransferase") (EC 2.3.1.51) refers to an enzyme that converts 1-acyl-sn-glycerol-3-phosphate (lysophosphatidic acid or LPA) into 1,2-diacyl-sn-glycerol-3-phosphate (phosphatidic acid or PA) by incorporating an acyl moiety at the sn-2 position of the glycerol backbone. This is the second step in TAG assembly, placing the fatty acid in the sn-2 position and releasing CoA.

As used herein, the term "diacylglycerol acyltransferase" or "DGAT" (also known as "diglyceride acyltransferase") (EC 2.3.1.20) refers to an enzyme that introduces another acyl chain from a donor acyl-CoA into the sn-3 position of the diacylglycerol (DAG), forming a TAG. This is the last step in TAG assembly, placing the fatty acid in the sn-3 position and releasing CoA.

As used herein, the term "preference" when used in connection with an acyl-CoA substrate of a GPAT, LPAT or DGAT, means that a GPAT, LPAT, or DGAT has increased activity with a specific type of acyl-CoA with an acyl chain having a target characteristic compared to another type of acyl-CoA with an acyl chain not having the target characteristic. For example, a GPAT, LPAT or DGAT has preference for saturated acyl-CoAs over unsaturated acyl-CoAs, or vice versa. In another example, a GPAT, LPAT or DGAT has preference for acyl-CoAs of different acyl chain lengths, such short-chain acyl-CoAs, medium-chain acyl-CoAs, long-chain acyl-CoAs or very long-chain acyl-CoAs. Expressing a GPAT with a specific acyl-CoA preference increases incorporation of the acyl moiety of the preferred acyl-CoAs into the sn-1 position of the TAG. Expressing a LPAT with specific acyl-CoA preference increases incorporation of the acyl moiety of the preferred acyl-CoAs into the sn-2 position of the TAG. Expressing a DGAT with a specific acyl-CoA preference increases incorporation of the acyl moiety of the preferred acyl-CoAs into the sn-3 position of the TAG. For example, expressing a GPAT, LPAT, and/or DGAT with a preference for saturated acyl-CoAs will result in increased production of TAGs with saturated fatty acids at specific positions. In addition to having preference for the acyl-CoA, LPATs and DGATs can have preference for certain LPA and DAG substrates, respectively. This preference might be based on the type of fatty acid at the sn-1 position of a LPA in case of an LPAT, or the fatty acids at the sn-1 and sn-2 positions of a DAG in case of a DGAT. For example, a LPAT has preference for LPA with a saturated fatty acid at the sn-1 position, while another LPAT prefers unsaturated fatty acids at the sn-1 position. Furthermore, a LPAT may have preference for LPA with a long-chain fatty acid at the sn-1 position, while another LPAT might prefer short-chain fatty acids at the sn-1 position.

As used herein, the term "activity" when used in connection with an acyl-CoA substrate of a GPAT, LPAT or DGAT, means that a GPAT, LPAT, or DGAT is active on a specific type of acyl-CoA. However, the GPAT, LPAT or DGAT might also be equally, less, or more active with a different type of acyl-CoA. Therefore, "activity" as used herein does not necessarily indicate "preference".

Also, as used herein, the terms "nucleotide sequence", "nucleic acid", "nucleic acid molecule", "oligonucleotide" and "polynucleotide" refer to ribonucleic acid (RNA) or deoxyribonucleic acid (DNA), including complementary DNA (cDNA), a DNA fragment or portion, genomic DNA, synthetic DNA, plasmid DNA, messenger RNA (mRNA), and anti-sense RNA, any of which can be single stranded or double stranded, linear or branched, or a hybrid thereof. Nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25.

As used herein the term "recombinant" when used means that a particular nucleic acid (DNA or RNA) is the product of various combinations of cloning, restriction, and/or ligation steps resulting in a construct having a structural coding or non-coding sequence distinguishable from endogenous nucleic acids found in natural systems.

As used herein, the term "gene" refers to a nucleic acid molecule capable of being used to produce mRNA, anti-sense RNA, micro RNA (miRNA), anti-microRNA anti-sense oligodeoxyribonucleotide (AMO) and the like. Genes may or may not be capable of being used to produce a functional protein or gene product. Genes can include both coding and non-coding regions, e.g., introns, regulatory elements, promoters, enhancers, termination sequences and/or 5' and 3' untranslated regions. A gene may be "isolated"

by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

A "disrupted gene" as defined herein involves any mutation or modification to a gene resulting in a partial or fully non-functional gene and gene product. Such a mutation or modification includes, but is not limited to, a missense mutation, a nonsense mutation, a deletion, a substitution, an insertion, addition of a targeting sequence and the like. Furthermore, a disruption of a gene can be achieved also, or alternatively, by mutation or modification of control elements controlling the transcription of the gene, such as mutation, exchange, or other modification in a promoter, terminator and/or enhancement elements. In such a case, such a mutation or modification results in partially or fully loss of transcription of the gene, i.e., a lower or reduced transcription as compared to native and non-modified control elements. As a result a reduced, if any, amount of the gene product will be available following transcription and translation. Furthermore, disruption of a gene could also entail adding or removing a localization signal from the gene, resulting in decreased presence of the gene product in its native subcellular compartment.

The objective of gene disruption is to reduce the available amount of the gene product, including fully preventing any production of the gene product, or to express a gene product that lacks or having lower enzymatic activity as compared to the native or wild type gene product. Therefore, as used herein, the term "disruption" encompasses both deletion and downregulation of a gene.

As used herein the term "deletion" or "knock-out" refers to a gene that is inoperative or knocked out.

The term "lowered activity" or "attenuated activity" when related to an enzyme refers to a decrease in the activity of the enzyme in its native compartment compared to a control or wild-type state. Manipulations that result in attenuated activity of an enzyme include, but are not limited to, a missense mutation, a nonsense mutation, a deletion, a substitution, an insertion, addition of a targeting sequence, removal of a targeting sequence, or the like. Furthermore, attenuation of enzyme activity can be achieved also, or alternatively, by mutation or modification of control elements controlling the transcription of the gene encoding the enzyme, such as mutation or modification in a promoter, terminator and/or enhancement elements. A cell that contains modifications that result in attenuated enzyme activity will have a lower activity of the enzyme compared to a cell that does not contain such modifications. Attenuated activity of an enzyme may be achieved by encoding a nonfunctional gene product, e.g., a polypeptide having essentially no activity, e.g., less than about 10% or even 5% as compared to the activity of the wild type polypeptide.

A "codon optimized" version of a gene refers to an exogenous gene introduced into a cell and where the codons of the gene have been optimized with regard to the particular cell. Generally, not all tRNAs are expressed equally or at the same level across species. Codon optimization of a gene sequence thereby involves changing codons to match the most prevalent tRNAs, i.e., to change a codon recognized by a low prevalent tRNA with a synonymous codon recognized by a tRNA that is comparatively more prevalent in the given cell. This way the mRNA from the codon optimized gene will be more efficiently translated. The codon and the synonymous codon encode the same amino acid.

As used herein, the term "allele" refers to a variant form of a given gene. This can include a mutated form of a gene where one or more of the amino acids encoded by the gene have been removed or substituted by a different amino acid.

As used herein, the terms "peptide", "polypeptide", and "protein" are used interchangeably to indicate to a polymer of amino acid residues. The terms "peptide", "polypeptide" and "protein" also includes modifications including, but not limited to, lipid attachment, glycosylation, glycosylation, sulfation, hydroxylation, γ-carboxylation of L-glutamic acid residues and ADP-ribosylation.

As used herein, the term "enzyme" is defined as a protein which catalyzes a chemical or a biochemical reaction in a cell. Usually, according to the present invention, the nucleotide sequence encoding an enzyme is operably linked to a nucleotide sequence (promoter) that causes sufficient expression of the corresponding gene in the cell to confer to the cell the ability to produce fatty acids.

As used herein, the term "genome" encompasses both the plasmids and chromosomes in a host cell. For instance, encoding nucleic acids of the present disclosure which are introduced into host cells can be portion of the genome whether they are chromosomally integrated or plasmids-localized.

As used herein, the term "promoter" refers to a nucleic acid sequence which has functions to control the transcription of one or more genes, and is located upstream with respect to the direction of transcription of the transcription initiation site of the gene. Suitable promoters in this context include both constitutive and inducible natural promoters as well as engineered promoters, which are well known to the person skilled in the art. In this application, promoters are designed with a "p" in front of the gene name (e.g., "pTEF1" is the promoter of the gene TEF1).

Suitable promoters for use in fungal cells, such as yeast cells, may be the promoters of PDC, GPD1, TEF1, PGK1 and TDH. Other suitable promoters include, but are not restricted to, the promoters of GAL1, GAL2, GAL10, GAL7, CUP1, HIS3, CYC1, ADH1, PGL, GAPDH, ADC1, URA3, TRP1, LEU2, TPI, AOX1 and ENO1.

As used herein, the term "promoter activity" refers to the ability of a promoter to facilitate expression of the gene lying immediately downstream of said promoter. Typical indicators of a promoter's activity include the timing of expression and level of expression of its downstream gene relative to other genes. A promoter with high or strong activity will lead to high levels of transcription of the gene lying immediately downstream of said promoter, subsequently resulting in high mRNA (and subsequently protein) levels of said gene. A promoter with weak or low activity will lead to low levels of transcription of the gene lying immediately downstream of said promoter, subsequently resulting in low mRNA levels of said gene. Promoter activity can usually be assessed by measuring the mRNA expression of its downstream gene, or by placing a reporter gene immediately downstream of a promoter and observing e.g., fluorescence or colour formation upon respective protein formation. Factors influencing the strength and activity of a promoter can include transcription factor binding (dependent on binding sites in the promoter), efficiency of recruiting RNA polymerases, environmental conditions, etc.

As used herein, the term "terminator" refers to a "transcription termination signal" if not otherwise noted. Terminators are sequences that hinder or stop transcription of a polymerase.

As used herein, a "recombinant fungal cell" according to the present disclosure is defined as a fungal cell, which contains additional copies or copy of an endogenous nucleic acid sequence and/or is transformed or genetically modified with polypeptide or a nucleotide sequence that does not naturally occur in the fungal cell. The wildtype fungal cell is defined as the parental cell of the recombinant fungal cell, as used herein.

As used herein, the terms "increase" and "enhance" (and grammatical variations thereof) indicate an elevation of at least about 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 100%, 150%, 200%, 300%, 400%, 500% or more, or any range therein, as compared to a control.

As used herein, the terms "reduce", "diminish", "decrease" and "suppress" (and grammatical variations thereof) indicate a decrease of at least about, 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95% or 100%, or any range therein, as compared to a control.

A reduced expression of a gene as used herein involves a genetic modification that reduces the transcription of the gene, reduces the translation of the mRNA transcribed from the gene and/or reduces post-translational processing of the protein translated from the mRNA. Such genetic modification includes insertion(s), deletion(s), replacement s) or mutation(s) applied to the control sequence, such as a promoter and enhancer, of the gene. For instance, the promoter of the gene could be replaced by a less active or inducible promoter to thereby result in a reduced transcription of the gene. Also a knock-out of the promoter would result in reduced, typically zero, expression of the gene. In addition, the coding sequence of the gene could be modified for reduced expression, for example by the addition of degradation tags (e.g. ubiquitin) that promote rapid degradation of the protein product of the gene.

Different nucleic acids or proteins having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity, i.e., sequence similarity or identity. Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity, e.g., at least about 70%, 75%, 80%, 81%, 82%, 83%, 84%, 85%, 86%, 87%, 88%, 89%, 90%, 91%, 92%, 93%, 94%, 95%, 96%, 97%, 98%, 99%, and/or 100%, to said nucleotide sequence.

The terms "overexpress" and "upregulate" (and grammatical variations thereof) as used herein refers to higher levels of activity of a gene, e.g., transcription of the gene; higher levels of translation of mRNA into protein; and/or higher levels of production of a gene product, e.g., polypeptide, than would be in the cell in its native or control, e.g., not transformed with the particular heterologous or recombinant polypeptides being overexpressed, state. A typical example of an overexpressed gene is a gene under transcription control of another promoter as compared to the native promoter of the gene. Also, or alternatively, other changes in the control elements of a gene, such as enhancers, could be used to overexpress the particular gene. Furthermore, modifications that affect, i.e., increase, the translation of the mRNA transcribed from the gene could, alternatively or in addition, be used to achieve an overexpressed gene as used herein. These terms can also refer to an increase in the number of copies of a gene and/or an increase in the amount of mRNA and/or gene product in the cell. Overexpression can also be achieved by introducing one or more exogenous versions of the gene from another species. Overexpression can result in levels that are 25%, 50%, 100%, 200%, 500%, 1000%, 2000% or higher in the cell, or any range therein, as compared to control levels. When a heterologous gene is expressed in a cell, it can also be said that this gene is "overexpressed" even if such expression is weak, since the gene product is still present at a higher concentration in the cell modified for expression than non-modified control.

In some cases, upregulation or overexpression might also be specific to the fermentation stage. For example, a modification could be introduced that results in the gene having a similar expression level compared to a non-modified cell during the growth stage, but a higher expression level compared to a non-modified cell during the production stage. This can be achieved by using a promoter with higher activity during the production phase. In this case, the gene can still be said to be upregulated. Therefore, as used herein "upregulation" or "overexpression" refers to higher levels of the expression of a gene or activity of the gene product at any point during the fermentation process.

The term "downregulation" or "down-regulation" as used herein refers to lower levels of activity of a gene, e.g., transcription of the gene; lower levels of translation of mRNA into protein; and/or lower levels of production of a gene product, e.g., polypeptide, than would be in the cell in its native or control, e.g., not transformed with the particular heterologous or recombinant polypeptides being overexpressed, state. A typical example of downregulated gene is a gene under transcription control of another promoter with lower activity as compared to the native promoter of the gene. Also, or alternatively, other changes in the control elements of a gene, such as silencer elements, could be used to downregulate the particular gene. Furthermore, modifications that affect, i.e., decrease, the translation of the mRNA transcribed from the gene could, alternatively or in addition, be used to achieve a downregulated gene as used herein. These terms can also refer to a decrease in the amount of mRNA and/or gene product in the cell. In addition, this term can be used to refer to a gene that is disrupted or completely deleted. Downregulation can result in levels that are 10%, 20%, 50% or 100% lower in the cell, or any range therein, as compared to control levels. In some cases, downregulation might also be specific to the fermentation stage. For example, a modification could be introduced that results in the gene having a similar expression level compared to a non-modified cell during the growth stage, but a lower expression level compared to a non-modified cell during the production stage. This can be achieved by using a promoter with lower activity during the production phase. In this case, the gene can still be said to be downregulated. Therefore, as used herein "downregulation" refers to lower levels of the expression of a gene or activity of the gene product at any point during the fermentation process.

As used herein, the terms "exogenous" or "heterologous" when used with respect to a nucleic acid (RNA or DNA), protein or gene refer to a nucleic acid, protein or gene which occurs non-naturally as part of the cell, organism, genome, RNA or DNA sequence into which it is introduced, including non-naturally occurring multiple copies of a naturally occurring nucleotide sequence. Such an exogenous gene could be a gene from another species or strain, a modified, mutated or evolved version of a gene naturally occurring in the host cell or a chimeric version of a gene naturally occurring in the host cell or fusion genes. In these former cases, the modification, mutation or evolution causes a change in the nucleotide sequence of the gene to thereby obtain a modified, mutated or evolved gene with another nucleotide sequence as compared to the gene naturally occurring in the host cell. Evolved gene refers to genes encoding evolved genes and obtained by genetic modification, such as mutation or exposure to an evolutionary pressure, to derive a new gene with a different nucleotide sequence as compared to the wild type or native gene. A chimeric gene is formed through the combination of portions of one or more coding sequences to produce a new gene. These modifications are distinct from a fusion gene, which merges whole gene sequences into a single reading frame and often retain their original functions.

An "endogenous", "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type mRNA" is an mRNA that is naturally occurring in or endogenous to the organism. A "homologous" nucleic acid sequence is a nucleotide sequence naturally associated with a host cell into which it is introduced.

As used herein, the term "modified", when it is used with respect to an organism, refers to a host organism that has been modified to increase production of specific fatty acids and/or triacylglycerols, as compared with an otherwise identical host organism that has not been so modified. In principle, such "modification" in accordance with the present disclosure may comprise any physiological, genetic, chemical, or other modification that appropriately alters production and/or composition of fatty acids in a host organism as compared with such production in an otherwise identical organism which is not subject to the said modification. In addition, such "modification" may also comprise any physiological, genetic, chemical, or other modification that appropriately alters the production of triacylglycerols and/or the types of triacylglycerols present, in a host organism as compared with such production in an otherwise identical organism which is not subject to the said modification. In most of the embodiments, however, the modification will comprise a genetic modification. In certain embodiments, as described herein, the modification comprises introducing genes into a host cell. In some embodiments, a modification comprises at least one physiological, chemical, genetic, or other modification; in other embodiments, a modification comprises more than one chemical, genetic, physiological, or other modification. In certain aspects where more than one modification is made use of, such modifications can include any combinations of physiological, genetic, chemical, or other modification (e.g., one or more genetic, chemical and/or physiological modification(s)). Genetic modifications which boost the activity of a polypeptide include, but are not limited to: introducing one or more copies of a gene encoding the polypeptide (which may distinguish from any gene already present in the host cell encoding a polypeptide having the same activity); altering a gene present in the cell to increase transcription or translation of the gene (e.g., altering, adding additional sequence to, replacement of one or more nucleotides, deleting sequence from, or swapping for example, regulatory, a promoter or other sequence); and altering the sequence (e.g., non-coding or coding) of a gene encoding the polypeptide to boost activity (e.g., by increasing enzyme activity, decreasing feedback inhibition, targeting a specific subcellular location, boosting mRNA stability, boosting protein stability). Genetic modifications that reduce activity of a polypeptide include, but are not limited to: deleting a portion or all of a gene encoding the polypeptide; inserting a nucleic acid sequence which disrupts a gene encoding the polypeptide; changing a gene present in the cell to reduce transcription or translation of the gene or stability of the mRNA or polypeptide encoded by the gene (for example, by adding additional sequence to, altering, deleting sequence from, replacement of one or more nucleotides, or swapping for example, replacement of one or more nucleotides, a promoter, regulatory or other sequence).

The term "overproducing" is used herein in reference to the production of fatty acids or TAGs in a fungal cell and indicates that the fungal cell is producing more fatty acids or TAGs by virtue of the introduction of nucleic acid sequences which encode different polypeptides involved in the fungal cell's metabolic pathways or as a result of other modifications as compared with the unmodified fungal cell or wild-type fungal cell.

As used herein, the term "de-regulated" or "deregulated" when referring to expression or activity level of an endogenous enzyme refers to a change in the expression or activity of that enzyme as a result of manipulation, for instance genetic manipulation, compared to a non-manipulated control. De-regulation can be achieved by various methods in the art, for example, by changing the promoter that drives the expression of the enzyme. For example, exchanging the promoter of a constitutively expressed enzyme with a promoter that leads to inducible expression can be considered as "de-regulation" of the expression of that enzyme. Importantly, fungal cells in which the endogenous activity of an enzyme has been de-regulated still contains the endogenous activity, and are therefore different than fungal cells in which the activity has been completely abolished.

As used herein, the term "growth phase" refers to a phase or stage in the fermentation process when the fungal cells are rapidly dividing, resulting primarily in the generation of cellular mass ("biomass"). The growth phase typically occurs in the beginning of the fermentation process and is often characterized by high starting concentration of a carbon source in the media, e.g., glucose concentration of >10 g/L.

As used herein, the term "production phase", and in particular fatty acid and/or fatty acid-derived product production phase, refers to a phase or stage in the fermentation process when the fungal cells are producing the product of interest, for example, a fatty acid or a fatty acid-derived product. Typically, fungal cells are not dividing, or dividing very slowly in the production phase, as most cellular resources are directed towards production. The production phase typically follows the growth phase. The production phase is often characterized by a nutrient limitation, e.g., glucose- and/or nitrogen-limited conditions.

As used herein, the term "glucose limitation" refers to cultivation conditions where the glucose concentration in the medium is kept very low, e.g., 10 g/L or less. This is typically done to allow pure respiratory growth of Crabtree-positive yeast species. Typically, implementation for glucose limiting conditions is continuous and fed-batch cultivations, where the rate glucose is fed to the culture equals the consumption.

As used herein, the term "flux", "metabolic flux" or "carbon flux" refers to the rate of turnover of molecules through a given reaction or a set of reactions. Flux in a metabolic pathway is regulated by the enzymes involved in the pathway. Pathways or reactions characterized by a state of increased flux compared to a control have an increased rate of generation of products from given substrates. Pathways or reactions characterized by a state of decreased flux compared to a control have a decreased rate of generation of products from given substrates. Flux towards products of interest can be increased by removing or decreasing competitive reactions or by increasing the activities of enzymes involved in generation of said products.

As used herein the term "vector" is defined as a linear or circular DNA molecule comprising a polynucleotide encoding a polypeptide of the invention, and which is operably linked to additional nucleotides that ensure its expression. Vectors are used to artificially carry foreign genetic material into an organism, resulting genetic modification of the organism. "Introducing" in the context of a fungal cell means contacting a nucleic acid molecule with the fungal cell in such a manner that the nucleic acid molecule gains access to the interior of the fungal cell. Accordingly, polynucleotides and/or nucleic acid molecules can be introduced into the fungal cell in a single transformation event, or in separate transformation events. Thus, the term "transformation" as used herein refers to the introduction of a heterologous nucleic acid into a fungal cell. Transformation of a fungal cell can be stable or transient.

"Transient transformation" in the context of a polynucleotide means that a polynucleotide is introduced into the cell and does not integrate into the genome of the cell.

By "stably introducing" or "stably introduced" in the context of a polynucleotide introduced into a cell, it is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. Stable transformation as used herein can also refer to a nucleic acid molecule that is maintained extrachromosomally, for example, as a minichromosome.

Embodiments of the present invention also encompass variants of the polypeptides as defined herein. As used herein, a "variant" means a polypeptide in which the amino acid sequence differs from the base sequence from which it is derived in that one or more amino acids within the sequence are substituted for other amino acids. For example, a variant of SEQ ID NO:1 may have an amino acid sequence at least about 70% identical to SEQ ID NO:1, for example, at least about 70%, 75%, 80%, 85%, 90%, 91%, 92%, 93%, 94%, 95%, 96%, 97%, 98%, 99% or about 100% identical. The variants and/or fragments are functional variants/fragments in that the variant sequence has similar or identical functional enzyme activity characteristics to the enzyme having the non-variant amino acid sequence specified herein (and this is the meaning of the term "functional variant" as used throughout this specification).

A "functional variant" or "functional fragment" of any of the presented amino acid sequences, therefore, is any amino acid sequence which remains within the same enzyme category (i.e., has the same EC number) as the non-variant sequences. Methods of determining whether an enzyme falls within a particular category are well known to the skilled person, who can determine the enzyme category without use of inventive skill. Suitable methods may, for example, be obtained from the International Union of Biochemistry and Molecular Biology.

Amino acid substitutions may be regarded as "conservative" where an amino acid is replaced with a different amino acid with broadly similar properties. Non-conservative substitutions are where amino acids are replaced with amino acids of a different type.

By "conservative substitution" is meant the substitution of an amino acid by another amino acid of the same class, in which the classes are defined as follows:

Class Amino Acid Examples

Nonpolar and neutral: A, V, L, I, P, M, F, W, G
Polar and neutral: S, T, C, Y, N, Q
Acidic and polar: D, E
Basic and polar: K, R, H.

As it will be well known to those skilled in the art, altering the primary structure of a polypeptide by a conservative substitution may not significantly alter the activity of that polypeptide because the side-chain of the amino acid which is inserted into the sequence may be able to form similar bonds and contacts as the side chain of the amino acid which has been substituted out. This is so even when the substitution is in a region which is critical in determining the polypeptide's conformation.

In embodiments of the present invention, non-conservative substitutions are possible provided that these do not interrupt the enzyme activities of the polypeptides, as defined elsewhere herein. The substituted versions of the enzymes must retain characteristics such that they remain in the same enzyme class as the non-substituted enzyme, as determined using the NC-IUBMB nomenclature discussed above.

Broadly speaking, fewer non-conservative substitutions than conservative substitutions will be possible without altering the biological activity of the polypeptides. Determination of the effect of any substitution (and, indeed, of any amino acid deletion or insertion) is wholly within the routine capabilities of the skilled person, who can readily determine whether a variant polypeptide retains the enzyme activity according to aspects of the invention. For example, when determining whether a variant of the polypeptide falls within the scope of the invention (i.e., is a "functional variant or fragment" as defined above), the skilled person will determine whether the variant or fragment retains the substrate converting enzyme activity as defined with reference to the NC-IUBMB nomenclature mentioned elsewhere herein. All such variants are within the scope of the invention.

Using the standard genetic code, further nucleic acid sequences encoding the polypeptides may readily be conceived and manufactured by the skilled person, in addition to those disclosed herein. The nucleic acid sequence may be DNA or RNA, and where it is a DNA molecule, it may for example comprise a cDNA or genomic DNA. The nucleic acid may be contained within an expression vector, as described elsewhere herein.

Embodiments of the invention, therefore, encompass variant nucleic acid sequences encoding the polypeptides contemplated by embodiments of the invention. The term "variant" in relation to a nucleic acid sequence means any substitution of, variation of, modification of, replacement of, deletion of, or addition of one or more nucleotide(s) from or to a polynucleotide sequence, providing the resultant polypeptide sequence encoded by the polynucleotide exhibits at least the same or similar enzymatic properties as the polypeptide encoded by the basic sequence. The term includes allelic variants and also includes a polynucleotide (a "probe sequence") which substantially hybridizes to the polynucleotide sequence of embodiments of the present invention. Such hybridization may occur at or between low and high stringency conditions. In general terms, low stringency conditions can be defined as hybridization in which the washing step takes place in a 0.330-0.825 M NaCl buffer solution at a temperature of about 40-48° C. below the calculated or actual melting temperature (Tm) of the probe sequence (for example, about ambient laboratory temperature to about 55° C.), while high stringency conditions involve a wash in a 0.0165-0.0330 M NaCl buffer solution at a temperature of about 5-10° C. below the calculated or actual Tm of the probe sequence (for example, about 65° C.). The buffer solution may, for example, be SSC buffer (0.15M NaCl and 0.015M tri-sodium citrate), with the low stringency wash taking place in 3×SSC buffer and the high stringency wash taking place in 0.1×SSC buffer. Steps involved in hybridization of nucleic acid sequences have been described for example in Molecular Cloning, a laboratory manual [second edition] Sambrook et al. Cold Spring Harbor Laboratory, 1989, for example in Section 11 "Synthetic Oligonucleotide Probes" thereof (herein incorporated by reference)

Preferably, nucleic acid sequence variants have about 55% or more of the nucleotides in common with the nucleic acid sequence of embodiments of the present invention, more preferably at least 60%, 65%, 70%, 80%, 85%, or even 90%, 95%, 98% or 99% or greater sequence identity.

Variant nucleic acids of the invention may be codon-optimized for expression in a particular host cell. In this case, the nucleotide sequence of a codon-optimized gene might be substantially different from the nucleotide sequence of a non codon-optimized gene, but still encode an identical polypeptide.

As used herein, "sequence identity" refers to the percentage of matches of the same amino acid residues or the same nucleotides between two aligned polypeptide (protein) or nucleotide sequences, respectively.

The identity is determined by sequence alignment to determine the structural and/or functional relationships between the sequences. Gaps in either or both sequences are permitted in making the alignment in order to optimize the number of shared amino acids (or nucleotides in case of a nucleotide sequence), although the amino acids in each sequence must nonetheless remain in their proper order. Sequence identity between amino acid or nucleotide sequences can be determined by comparing an alignment of the sequences using the Needleman-Wunsch Global Sequence Alignment Tool available from the National Center for Biotechnology Information (NCBI), Bethesda, Md., USA, for example via http://blast.ncbi.nlm.nih.gov/Blast.cgi, using default parameter settings (for protein alignment, Gap costs Existence:11 Extension:1). Sequence comparisons and percentage identities mentioned in this specification have been determined using this software.

When referring to sequence databases, "Genbank: XXXXXX.Y" indicates the database as Genbank, the accession number as XXXXXX and the version number as Y. For example, GenBank: XP_006399069.1, means version 1 of accession number XP_006399069 in the GenBank database.

"UniProtKB/Swiss-Prot: XXXX, SV=Y" indicates that the database is UniProtKB/Swiss-Prot, the accession number is XXXX, and the sequence version is Y. For example, in UniProtKB/Swiss-Prot: F1S5L4, SV=3, the database is UniProtKB/Swiss-Prot, the accession number is F1S5L4, and the sequence version is 3.

The invention relates to a fungal cell suitable for production selected or desired triacylglycerol (TAG) species. Hence, the fungal cell is genetically modified to promote production of specific TAG species In a general aspect, the fungal cell is genetically modified for overexpression of an enzyme with triacylglycerol lipase activity, i.e., a triacylglycerol lipase (EC 3.1.1.3). The fungal cell is also genetically modified for expression of at least one heterologous enzyme selected from the group consisting of glycerol-3-phosphate acyltransferase (GPAT) (EC 2.3.1.15), lysophosphatidyl acyltransferase (LPAT) (EC 2.3.1.51), and diacylglycerol acyltransferase (DGAT) (EC 2.3.1.20).

Figure 2:
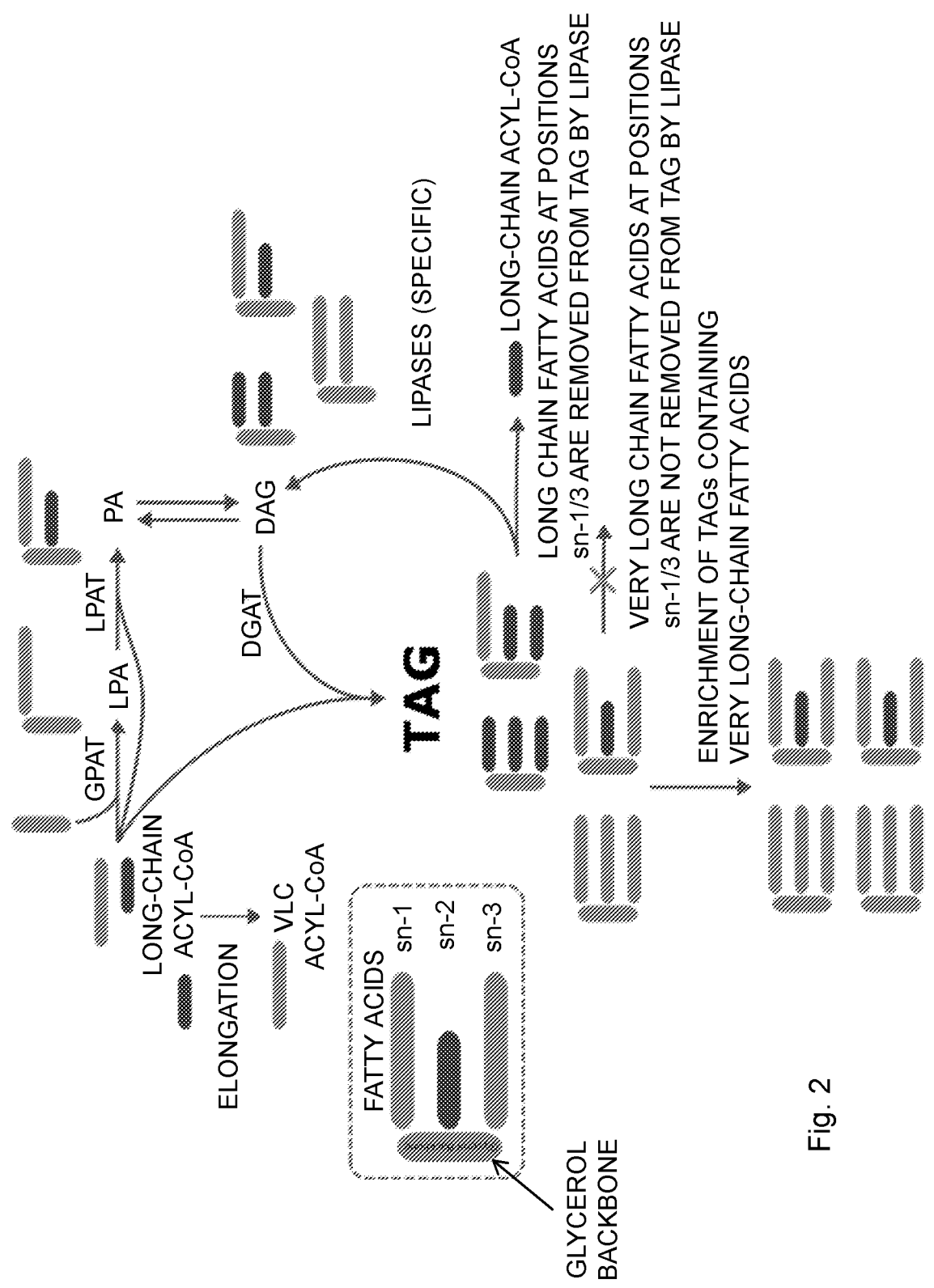
FIG. 2. Overview of a genetic engineering method for creating target TAG species. In this figure, TAGs containing very long-chain fatty acids at the sn-1 and sn-3 position are used as an illustrative, but non-limiting, example of target TAG species. In this example, specific GPATs and DGATs are expressed for increasing the specificity of the TAG biosynthetic pathway towards use of very long-chain acyl-CoAs. Expression of specific TAG lipases allows for a selective recycling of long-chain TAGs, resulting in accumulation of very long-chain TAG (VLCTAG) molecules.

The triacylglycerol lipase that is overexpressed in the fungal cell removes undesired fatty acids from triacylglycerols. This allows for replacement of the undesired fatty acids with desired fatty acids, resulting in increased amounts of the desired triacylglycerol species (FIG. 2). The triacylglycerol lipase can be either an endogenous triacylglycerol lipase that is overexpressed, or a heterologous triacylglycerol lipase that is overexpressed in the fungal cell, preferably a heterologous triacylglycerol lipase. To further increase the content of desired triacylglycerol species, the fungal cell is genetically modified to express at least one heterologous gene selected from the group consisting of GPAT, LPAT (also known as 1-acyl-sn-glycerol-3-phosphate acyltransferase), and DGAT. In an embodiment, GPAT(s), LPAT(s) and/or DGAT(s) that have specific fatty acid preferences can be selected to promote production of the desired TAG. The fungal cell of the invention preferably comprises these two genetic modifications, i.e., overexpression of triacylglycerol lipase and expression of heterologous GPAT, LPAT and/or DGAT. As will be further described herein, in other embodiments the fungal cell is genetically modified for overexpression of the triacylglycerol lipase or is genetically modified for expression of the heterologous GPAT, LPAT and/or DGAT.

In an embodiment, the at least one heterologous enzyme is capable of esterifying a triacylglycerol precursor with an acyl-coenzyme A (CoA) with an acyl chain having a target characteristic. In this embodiment, the triacylglycerol lipase has preferential for hydrolysis, from triacylglycerols, of fatty acids with an acyl chain not having the target characteristic over hydrolysis, from triacylglycerols, of fatty acids with an acyl chain having the target characteristic.

In this embodiment, the heterologous GPAT, LPAT and/or DGAT is capable of adding an acyl-CoA with an acyl chain having a target characteristic to the triacylglycerol precursor. The triacylglycerol lipase, however, has preference for removal of fatty acids from triacylglycerols with an acyl chain not having the target characteristic. This means that the combined enzymatic actions of the heterologous enzyme and the triacylglycerol lipase are addition of acyl-CoAs with acyl chains having the target characteristic and removal of fatty acids with acyl chains not having the target characteristic. As a consequence, an enrichment of TAG species containing fatty acids with acyl chains having the target characteristic is obtained. This is schematically shown in FIG. 2, in which very long-chain fatty acids are preferred in TAGs over long-chain fatty acids.

Characteristic of an acyl chain as used herein relate to a characteristic of the acyl chain in an acyl-CoA to be added to the triacylglycerol precursor to form another triacylglycerol precursor or a TAG and a characteristic of the acyl chain in a fatty acid of a TAG. Target characteristic implies that the acyl chain has a predefined or selected characteristic. Illustrative, but non-limiting, examples of such characteristics include length of the acyl chain, such as expressed in terms of short-chain acyl chain or short-chain fatty acid, medium-chain acyl chain or medium-chain fatty acid, long-chain acyl chain or long-chain fatty acid or very long-chain acyl chain or very long-chain fatty acid, or expressed in the number of carbon atoms in the acyl chain or fatty acid, such as less than 10 carbons, 12 to 14 carbons, 16 to 18 carbons or equal to or more than carbons; saturated or unsaturated acyl chain or fatty acid; or saturated, monosaturated or polyunsatured acyl chain or fatty acid.

TAGs consist of one glycerol backbone esterified with three fatty acyl chains. A first step in the TAG synthesis pathway catalyzed by GPAT, which esterifies a glycerol-3-phosphate molecule with an acyl chain from an acyl-CoA molecule to form a lysophosphatidic acid (LPA), with the acyl chain in the sn-1 position. The second step, catalyzed by a LPAT, introduces a second acyl chain, using again an acyl-CoA molecule, and transesterifying the acyl chain onto the sn-2 position of the LPA, creating phosphatidic acid (PA). The third step is the dephosphorylation of PA by a PA phosphatase to yield diacylglycerol (DAG). The final step is mediated by a DGAT, which introduces another acyl chain from a donor acyl-CoA into the sn-3 position of the DAG, forming a TAG. Accordingly, a triacylglycerol precursor as used herein includes glycerol-3-phosphate, which is a triacylglycerol precursor for GPAT; LPA, which is a triacylglycerol precursor for LPAT; and DGA, which is a triacylglycerol precursor for DGAT.

In the following, various embodiments of the general aspect will be described in more detail.

In some embodiments, it is desired to produce triacylglycerols that incorporate very long-chain fatty acids. This can be of interest to increase the melting temperature of the fat, or to create a food fat with low calorie count due to the low digestibility of very long-chain fatty acids.

In an embodiment, the at least one heterologous enzyme is capable of esterifying the triacylglycerol precursor with a very long-chain acyl-CoA. In this embodiment, the triacylglycerol lipase has lower lipase activity on very long-chain fatty acids, preferably at the sn-1 or sn-3 position, of triacylglycerols compared to long-chain fatty acids.

Hence, an aspect of the invention relates to a fungal cell capable of producing triacylglycerols. The fungal cell is genetically modified for overexpression of a triacylglycerol lipase and the fungal cell is genetically modified for expression of at least one heterologous enzyme selected from the group consisting of GPAT, LPAT and DGAT. In this aspect, the at least one heterologous enzyme is capable of esterifying a triacylglycerol precursor with a very long-chain fatty acyl-CoA and the triacylglycerol lipase has lower lipase activity on very long-chain fatty acids of triacylglycerols compared to long-chain fatty acids, preferably lower lipase activity on very long-chain fatty acids at sn-1 or sn-3 position of triacylglycerols compared to long-chain fatty acids.

In this aspect, the at least one heterologous enzyme is capable of introducing very long-chain fatty acids at the triacylglycerol precursor to thereby obtain triacylglycerol molecules with one or more such very long-chain fatty acids. In addition, the triacylglycerol lipase has lower lipase activity on such very long-chain fatty acids as compared to long-chain fatty acids. This means that the triacylglycerol lipase thereby preferentially removes long-chain fatty acids from triacylglycerol molecules while leaving any very long-chain fatty acids. The removal of a long-chain fatty acid from triacylglycerol molecules firstly implies that the sn position of the triacylglycerol molecule, from which the long-chain fatty acid was removed by the triacylglycerol lipase, is now available for esterification to enable addition of a very long-chain fatty acid. In addition, the hydrolysed long-chain fatty acid could be recycled and used as a substrate for elongation to form a very long-chain acyl-CoA as indicated in FIG. 2. Hence, these combined enzymatic actions lead to an enrichment of triacylglycerol species with one or more very long-chain fatty acids.

In a particular embodiment, the at least one heterologous enzyme has preference for esterifying the triacylglycerol precursor with a very long-chain acyl-CoA over esterifying the triacylglycerol precursor with a long-chain acyl-CoA. This means that the at least one heterologous enzyme preferentially adds a very long-chain acyl-CoA over a long-chain acyl-CoA to the triacylglycerol precursor.

In an embodiment, the fungal cell is genetically modified for increased production of triacylglycerol species containing very long-chain fatty acids in the sn-113 positions, i.e., in the sn-1 and/or sn-3 positions. This is achieved by overexpression of a heterologous GPAT and/or a heterologous DGAT suitable for production of triacylglycerols containing very long-chain fatty acids in the sn-1/3 positions.

In an embodiment, the fungal cell is genetically modified for expression of a heterologous GPAT with activity, preferably preference, for very long-chain acyl-CoA. In an embodiment, the heterologous GPAT is selected from the group consisting of GPAT7 from *Brassica napus* (SEQ ID NO: 1), *Brassica napus* (probable) GPAT3 (SEQ ID NO: 2), *Raphidocelis subcapitata* Rsub_06287 (SEQ ID NO: 3), *Micractinium conductrix* C2E20_2678 (SEQ ID NO: 4), *Arabidopsis thaliana* GPAT4 (SEQ ID NO: 5), *Brassica napus* GPAT9 (SEQ ID NO: 6), *Eutrema salsugineum* GPAT7 (GenBank: XP_006399069.1), *Eutrema salsugineum* GPAT5 (GenBank: XP_006407448.1), *Abrus precatorius* GPAT5 (GenBank: XP_027332324.1), *Raphanus sativus* GPAT3 (GenBank: XP_018473253.1), *Camelina sativa* GPAT2 (GenBank: XP_010480923.1), *Lobosphaera incisa* ALK24260.1 (GenBank: ALK24260.1), *Chlamydomonas reinhardtii* CHLRE_06g273250v5 (GenBank: AFC93411.1), *Gossypium barbadense* GPAT2 (GenBank: AGW28123.1), *Chlorella sorokiniana* C2E21_0650 (GenBank: PRW61402.1), *Auxenochlorella protothecoides* F751_5853 (GenBank: XP_011399977.1), *Trebouxia* sp. FRX49_04955 (GenBank: KAA6424781.1), and a heterologous GPAT having at least 70% sequence identity, preferably at least 80% sequence identity, and more preferably at least 90% sequence identity to any of the above listed heterologous GPATs. In a preferred embodiment, the heterologous GPAT is selected from the group consisting of *Brassica napus* GPAT7 (SEQ ID NO: 1), *Brassica napus* GPAT3 (SEQ ID NO: 2), *Raphidocelis subcapitata* Rsub_06287 (SEQ ID NO: 3), *Micractinium conductrix* C2E20_2678 (SEQ ID NO: 4), *Arabidopsis thaliana* GPAT4 (SEQ ID NO: 5), *Brassica napus* GPAT9 (SEQ ID NO: 6), and a glycerol-3-phosphate acyltransferase having at least 70% sequence identity, preferably at least 80% sequence identity, and more preferably at least 90% sequence identity to any of SEQ ID NO: 1-6.

In some embodiments, the GPAT with activity on very long-chain acyl-CoA is localized to the endoplasmic reticulum, cytosol, or lipid body of the fungal cell. This is achieved through removal of localization signals to other subcellular compartments from the expressed GPAT, and/or addition of localization signals to the desired subcellular compartment to the amino acid sequence of the expressed GPAT.

A particular aspect relates to a fungal cell capable of producing triacylglycerols. The fungal cell is genetically modified for expression of a heterologous GPAT selected from the above mentioned groups of heterologous GPATs. In this particular aspect, the fungal cells is not genetically modified for overexpression of a triacylcelygerol lipase. In an embodiment, the fungal cell is capable of producing triacylgylcerols with very long-chain fatty acids.

In another embodiment, the fungal cell is genetically modified for expression of a heterologous DGAT with activity, preferably preference, for very long-chain acyl-CoAs. In an embodiment, the heterologous DGAT is selected from the group consisting of *Brassica napus* DGAT1-1 (SEQ ID NO: 7), *Brassica napus* DGAT1-2 (SEQ ID NO: 8), *Brassica napus* DGAT1.a (SEQ ID NO: 9), *Tropaeolum majus* DGAT (SEQ ID NO: 10), *Brassica juncea* DGAT2 (GenBank: AAY40785.1, *Capsella rubella* DGAT1 (GenBank: XP_006299296.1), *Prunus sibirica* DGAT1 (GenBank: AIX97817.1), *Zea mays* DGAT1-2 (GenBank: PWZ17600.1), *Crambe hispanica* subsp. *abyssinica* DGAT1A (GenBank: QFQ61503.1), *Brassica oleracea* var. *oleracea* DGAT1 (GenBank: XP_013593589.1), *Xanthoceras sorbifolium* DGAT1 (GenBank: AG032048.1), *Physcomitrium patens* DGAT1-2 (GenBank: XP_024385355.1), *Eutrema salsugineum* DGAT1 (GenBank: XP_006409057.1), *Pistacia vera* DGAT1A (GenBank: XP_031255702.1), *Aegilops tauschii* subsp. *tauschii* DGAT1 (GenBank: XP_020167275.1), *Theobroma cacao* DGAT1 (GenBank accession no: XP_017982745.1), *Citrus clementina* DGAT1 (GenBank: XP_006451508.2), *Durio zibethinus* DGAT1 (GenBank: XP_022732572.1), *Quercus lobate* DGAT1 (GenBank: XP_030953050.1), *Arachis duranensis* DGAT1A (GenBank: XP_015973649.1), *Cuphea avigera* var. *pulcherrima* DGAT1 (GenBank: ANN46862.1), *Hibiscus syriacus* DGAT1 (GenBank: KAE8712543.1), and a heterologous DGAT having at least 70% sequence identity, preferably at least 80% sequence identity, and more preferably at least 90% sequence identity to any of the above listed heterologous DGATs. In a preferred embodiment, the heterologous DGAT is selected from the group consisting of *Brassica napus* DGAT1-1 (SEQ ID NO: 7), *Brassica napus* DGAT1-2 (SEQ ID NO: 8), *Brassica napus* DGAT1.a (SEQ ID NO: 9), *Tropaeolum majus* DGAT (SEQ ID NO: 10), and a heterologous DGAT having at least 70% sequence identity, preferably at least 80% sequence identity, and more preferably at least 90% sequence identity to any of SEQ ID NO: 7-10. In a particular preferred embodiment, the heterologous DGAT is selected from the group consisting of *Tropaeolum majus* DGAT (SEQ ID NO: 10), and a heterologous DGAT having at least 70% sequence identity, preferably at least 80% sequence identity, and more preferably at least 90% sequence identity of SEQ ID NO: 10.

In some embodiments, the DGAT with activity on very long-chain acyl-CoA is localized to the endoplasmic reticulum, cytosol, or lipid body of the fungal cell. This is achieved through removal of localization signals to other subcellular compartments from the expressed DGAT, and/or addition of localization signals to the desired subcellular compartment to the amino acid sequence of the expressed DGAT.

A particular aspect relates to a fungal cell capable of producing triacylglycerols. The fungal cell is genetically modified for expression of a heterologous DGAT selected from the above mentioned groups of heterologous DGATs. In this particular aspect, the fungal cells is not genetically modified for overexpression of a triacylcelygerol lipase. In an embodiment, the fungal cell is capable of producing triacylgylcerols with very long-chain fatty acids.

In an embodiment, the fungal cell is genetically modified for overexpression of a triacylglycerol lipase having lower activity on very long-chain fatty acids, in particular at the sn-113 positions, compared to long-chain fatty acids. This selective lipase activity results in removal of long chain fatty acids from triacylglycerol, in particular from the sn-113 positions, and increased abundance of triacylglycerols with very long chain fatty acids, in particular in the sn-113 positions. In an embodiment, the triacylglycerol lipase is selected from a group consisting of *Homo sapiens* PNLIP (SEQ ID NO: 11), *Yarrowia lipolytica* Lip2 (SEQ ID NO: 12), *Yarrowia deformans* Lip1 (SEQ ID NO: 147), *Yarrowia phangngaensis* Lip2a (GenBank: CDX09915.1), *Yarrowia phangngaensis* Lip2d (GenBank: CDX09918.1), *Yarrowia phangngaensis* Lip2e (GenBank: CDX09919.1), *Yarrowia phangngaensis* Lip2b (GenBank: CDX09916.11), *Yarrowia lipolytica* Lip11 (GenBank: AFH77826.1), *Candida hispaniensis* LIP2b (GenBank: CDX09892.1), and a triacylglycerol lipase having at least 70% sequence identity, preferably at least 80% sequence identity, and more preferably at least 90% sequence identity to any of the above listed triacylglycerol lipases. In a preferred embodiment, the triacylglycerol lipase selected is selected from the group consisting of *Yarrowia lipolytica* Lip2 (SEQ ID NO: 12), and a triacylglycerol lipase having at least 70% sequence identity, preferably at least 80% sequence identity, and more preferably at least 90% sequence identity to SEQ ID NO: 12.

In some embodiments, the triacylglycerol lipase with lower activity on very long-chain fatty acids compared to long-chain fatty acids is expressed without a secretion signal. Secretion signals within amino acid sequences can be detected using SignalP 5.0 (Almagro Armenteros et al, 2019), Signal-BLAST (Franks and Sippl, 2008), or PrediSi.

In an embodiment, the fungal cell is genetically modified for overexpression a triacylglycerol lipase having lower lipase activity on very long-chain fatty acids on triacylglycerols compared to long-chain fatty acids, such as any of the triacylglycerol lipases mentioned above, and for expression of a heterologous GPAT with activity, preferably preference, for very long-chain acyl-CoAs, such as any of the GPAT mentioned above.

In another embodiment, the fungal cell is genetically modified for overexpression of a triacylglycerol lipase having lower lipase activity on very long-chain fatty acids on triacylglycerols compared to long-chain fatty acids, such as any of the triacylglycerol lipases mentioned above, and for expression of a heterologous DGAT with activity, preferably preference, for very long-chain acyl-CoAs, such as any of the DGAT mentioned above.

In a further embodiment, the fungal cell is genetically modified for overexpression a triacylglycerol lipase having lower lipase activity on very long-chain fatty acids on triacylglycerols compared to long-chain fatty acids, such as any of the triacylglycerol lipases mentioned above, for expression of a heterologous GPAT with activity, preferably preference, for very long-chain acyl-CoAs, such as any of the GPAT mentioned above and for expression of a heterologous DGAT with activity, preferably preference, for very long-chain acyl-CoAs, such as any of the DAGT mentioned above.

In a preferred embodiment, the fungal cell is genetically modified for expression of at least one heterologous GPAT and and at least one heterologous DGAT, preferably any of the heterologous GPAT and DGAT as mentioned above. In a particular embodiment, the fungal cell is genetically modified for expression of:

a heterologous GPAT selected from the group consisting of *Brassica napus* GPAT7 (SEQ ID NO: 1), *Brassica napus* GPAT3 (SEQ ID NO: 2), *Raphidocelis subcapitata* Rsub_06287 (SEQ ID NO: 3), *Micractinium conductrix* C2E20_2678 (SEQ ID NO: 4), *Arabidopsis thaliana* GPAT4 (SEQ ID NO: 5), *Brassica napus* GPAT9 (SEQ ID NO: 6), and a glycerol-3-phosphate acyltransferase having at least 70% sequence identity, preferably at least 80% sequence identity, and more preferably at least 90% sequence identity to any of SEQ ID NO: 1-6; and a heterologous DGAT selected from the group consisting of *Brassica napus* DGAT1-1 (SEQ ID NO: 7), *Brassica napus* DGAT1-2 (SEQ ID NO: 8), *Brassica napus* DGAT1.a (SEQ ID NO: 9), *Tropaeolum majus* DGAT (SEQ ID NO: 10), and a heterologous DGAT having at least 70% sequence identity, preferably at least 80% sequence identity, and more preferably at least 90% sequence identity to any of SEQ ID NO: 7-10.

In a preferred embodiment, the fungal cell is *Saccharomyces cerevisiae* or *Yarrowia lipolytica* and is genetically modified for:

expression of a heterologous GPAT selected from the group consisting of *Brassica napus* GPAT7 (SEQ ID NO: 1), *Brassica napus* GPAT3 (SEQ ID NO: 2), or another heterologous GPAT having at least 70% sequence identity, preferably at least 80% sequence identity, and more preferably at least 90% sequence identity to either of SEQ ID NO: 1-2;

expression of *Tropaeolum majus* DGAT (SEQ ID NO: 10), or another heterologous DGAT having at least 70% sequence identity, preferably at least 80% sequence identity, and more preferably at least 90% sequence identity to SEQ ID NO: 10; and overexpression of *Yarrowia lipolytica* Lip2 (SEQ ID NO: 12), or another triacylglycerol lipase having at least 70% sequence identity, preferably at least 80% sequence identity, and more preferably at least 90% sequence identity to SEQ ID NO: 12.

In some embodiments, the fungal cell is genetically modified to for production of animal like fats. This can include modifications to increase the content of triacylglycerol species that contain saturated fatty acids.

In an embodiment, the at least one heterologous enzyme is capable of esterifying the triacylglycerol precursor with a saturated fatty acyl-CoA. In this embodiment, the triacylglycerol lipase has higher lipase activity on unsaturated fatty acids of triacylglycerols compared to saturated fatty acids.

Hence, an aspect of the invention relates to a fungal cell capable of producing triacylglycerols. The fungal cell is genetically modified for overexpression of a triacylglycerol lipase and the fungal cell is genetically modified for expression of at least one heterologous enzyme selected from the group consisting of GPAT, LPAT and DGAT. In this aspect, the at least one heterologous enzyme is capable of esterifying a triacylglycerol precursor with a saturated fatty acyl-CoA and the triacylglycerol lipase has higher lipase activity on unsaturated fatty acids of triacylglycerols compared to saturated fatty acids.

In this aspect, the at least one heterologous enzyme is capable of introducing saturated fatty acids at the triacylglycerol precursor to thereby obtain triacylglycerol molecules with one or more such saturated fatty acids. In addition, the triacylglycerol lipase has higher lipase activity on unsaturated fatty acids as compared to saturated fatty acids. This means that the triacylglycerol lipase thereby preferentially removes unsaturated fatty acids from triacylglycerol molecules while leaving any saturated fatty acids. The removal of an unsaturated fatty acid from triacylglycerol molecules implies that the sn position of the triacylglycerol molecule, from which the unsaturated fatty acid was removed by the triacylglycerol lipase, is now available for esterification to enable addition of a saturated fatty acid. Hence, these combined enzymatic actions lead to an enrichment of triacylglycerol species with one or more saturated fatty acids.

In this aspect, the expression of the at least one heterologous enzyme increases the saturation level of triacylglycerols or lipids in the fungal cell, i.e., increases the % saturation of triacylglycerols or lipids in the fungal cell.

In a particular embodiment, the at least one heterologous enzyme has preference for esterifying the triacylglycerol precursor with a saturated fatty acyl-CoA over esterifying the triacylglycerol precursor with an unsaturated fatty acyl-CoA. This means that the at least one heterologous enzyme preferentially adds a saturated fatty acyl-CoA over an unsaturated fatty acyl-CoA to the triacylglycerol precursor.

In an embodiment, the fungal cell is genetically modified for expression of a heterologous LPAT that has activity on saturated fatty acyl-CoAs and is selected from the group consisting of *Bos taurus* AGPAT4 (SEQ ID NO: 13, 14, or 15), *Bos taurus* AGPAT1 (SEQ ID NO: 16), *Bos taurus* AGPAT2 (SEQ ID NO: 17), *Bos taurus* AGPAT3 (SEQ ID NO: 18), *Bos taurus* AGPAT5 (SEQ ID NO: 19), *Sus scrofa* AGPAT3 (GenBank: XP_020923983.1), *Sus scrofa* AGPAT4 (GenBank: XP_020953002.1 or XP_013839993.1), *Sus scrofa* AGPAT1 (GenBank: NP_001028180.1), *Sus scrofa* AGPAT5 (GenBank: NP_001137173.1), *Sus scrofa* AGPAT2 (GenBank: NP_001124006.1), *Arabidopsis thaliana* LPAT1 (SEQ ID NO: 20), *Homo sapiens* AGPAT 1 (SEQ ID NO: 21), *Spinacia oleracea* SOVF_088210 (SEQ ID NO: 22), *Mus musculus* LPCAT1 (SEQ ID NO: 23), *Brassica napus* LPAT1 (SEQ ID NO: 24), *Rippkaea orientalis* PCC8801_1274 (SEQ ID NO: 25), *Arabidopsis thaliana* At1g64355 (SEQ ID NO: 26), *Rattus norvegicus* AGPAT1 (SEQ ID NO: 27), *Arabidopsis lyrata* subsp. *lyrate* LPAT1 (GenBank: XP_006399069.10), *Capsella rubella* LPAT1 (GenBank: XP_006283996.1), *Brassica rapa* BAT2 (GenBank: XP_009137939.1), *Carica papaya* LPAT1 (GenBank: XP_021899225.1), *Beta vulgaris* LPAT1 (GenBank: XP_019104141.1), *Theobroma cacao* LPAT1 (GenBank: XP_007011912.2), *Theobroma cacao* TCM_037041 (GenBank: EOY29535.1), *Castor canadensis* LPAT1 (GenBank: XP_020038609.1), *Ovis aries* LPCAT1 (GenBank: XP_027835988.1), *Apteryx rowi* LPCAT1 (GenBank: XP_025933344.1), *Corvus moneduloides* LPCAT1 (GenBank: XP_031975461.1), unicellular cyanobacterium SU2 LPAT (GenBank: WP_085435536.1), *Crocosphaera watsonii* CwatDRAFT_5035 (GenBank: WP_007304638.1), *Leptolyngbya* sp. LPAT (GenBank: WP_059001909.1), *Chlorogloea* sp. LPAT (GenBank: WP_106369294.1), *Eutrema salsugineum* EUTSA_v10025500 mg (GenBank: XP_006412688.1), *Citrus sinensis* LPAT1 (GenBank: XP_024953042.1), *Ricinus communis* LPAT1 (GenBank: XP_015580990.1), *Corchorus capsularis* CCACVL1_23294 (GenBank: OM061729.1), *Zea mays* LPAT4 (GenBank: XP_023156062.1), *Zea mays* PLS1 (GenBank: NP_001148618.1), *Zea mays* 100304330 (Gen- Bank: NP_001159241.1), *Zea mays* PLS1 (GenBank: NP_001105919.1), *Zea mays* 100279795 (GenBank: NP_001146225.1), *Gallus gallus* AGPAT4 (GenBank: XP_025004744.1 or XP_015139813.1), *Gallus gallus* AGPAT3 (GenBank: XP_004934657.1), *Gallus gallus* AGPAT2 (GenBank: XP_001235300.2 or XP_015135279.1), *Gallus gallus* AGPAT1 (GenBank: XP_001233846.2), *Gallus gallus* AGPAT5 (GenBank: XP_419916.1), *Elaeis guineensis* LPAT4 (GenBank: XP_010936132.1), *Elaeis guineensis* LPAT (GenBank: XP_010908896.1), *Elaeis guineensis* LPAT (GenBank: XP_010908895.1), *Elaeis guineensis* LPAT1 (GenBank: XP_010919015.1), *Elaeis guineensis* PLS1 (GenBank: XP_010906759.1), *Elaeis guineensis* PLS1-like (GenBank: XP_010909860.2), *Elaeis guineensis* probable LPAT (GenBank: XP_029122716.1), *Elaeis guineensis* probable LPAT (GenBank: XP_029122715.1), *Elaeis guineensis* LPEAT1 (GenBank: XP_010905684.1, XP_010905687.1, XP_010905686.1, XP_010905685.1, XP_029124048.1, or XP_010938317.1), *Elaeis guineensis* LPEAT2 (GenBank: XP_010907482.1), *Oryctolagus cuniculus* AGPAT4 (GenBank: XP_008261974.1), *Oryctolagus cuniculus* AGPAT5 (GenBank: XP_008272401.1), *Oryctolagus cuniculus* AGPAT1 (GenBank: XP_008260842.1), *Oryctolagus cuniculus* LPCAT1 (GenBank: XP_008251109.1), *Oryctolagus cuniculus* LPCAT2 (GenBank: XP_002711569.1), *Mycolicibacterium smegmatis* ERS451418_00313 (SEQ ID NO: 28), *Mycolicibacterium smegmatis* Probable LPAT (SEQ ID NO: 29), *Mycolicibacterium smegmatis* ERS451418_06226 (SEQ ID NO: 30) *Mycolicibacterium smegmatis* ERS451418_02370 (SEQ ID NO: 31), *Mycolicibacterium smegmatis* ERS451418_05575 (SEQ ID NO: 32), *Mycolicibacterium smegmatis* ERS451418_04128 (SEQ ID NO: 33), *Mycolicibacterium smegmatis* ERS451418_06227 (SEQ ID NO: 34), *Mycolicibacterium smegmatis* BIN_B_00519 (SEQ ID NO: 35), *Mycolicibacterium smegmatis* D806_035910 (SEQ ID NO: 36), *Mycolicibacterium smegmatis* BIN_B_03706 (SEQ ID NO: 37), *Mycolicibacterium smegmatis* D806_003290 (SEQ ID NO: 38), *Cocos nucifera* probable LPAT (SEQ ID NO: 86), *Rhodococcus opacus* OPAG_06418 (GenBank: WP_005248852.1), *Rhodococcus opacus* probable LPAT (GenBank: WP_120659923.1), *Rhodococcus opacus* WSS_A22973 (GenBank: WP_005260161.1), *Rhodococcus opacus* C0055_26470 (GenBank: WP_005563677.1), *Rhodococcus opacus* A8787_443 (GenBank: WP_005567438.1), *Rhodococcus opacus* A8787_6776 (GenBank: WP_054246645.1), *Rhodococcus opacus* ROP_39250 (GenBank: WP_012691110.1), *Rhodococcus opacus* OPAG_06417 (GenBank: AHK27688.1), *Rhodococcus opacus* probable LPAT (GenBank: WP_169693721.1), *Rhodococcus opacus* probable LPAT (GenBank: WP_128642246.1), *Rhodococcus opacus* ROP_16990 (GenBank: WP_012688908.1), *Rhodococcus opacus* ROP_41110 (GenBank: WP_012691293.1), *Rhodococcus opacus* WSS_A18171 (GenBank: WP_005258325.1), *Rhodococcus opacus* WSS_A01200 (GenBank: WP_005253347.1), *Rhodococcus opacus* probable LPAT (GenBank: WP_128640254.1), *Rhodococcus opacus* OPAG_05898 (GenBank: EHI42409.1), *Clupea harengus* AGPAT3 (GenBank: XP_031414113.1 or XP_031414117.1), *Clupea harengus* AGPAT4 (GenBank: XP_012672439.2 or XP_031434633.1), *Clupea harengus* AGPAT5 (GenBank: XP_012695890.1), *Clupea harengus* AGPAT2 (GenBank: XP_012685618.1), *Amblyraja radiata* AGPAT4 (GenBank: XP_032881609.1), *Amblyraja radiata* AGPAT5 (GenBank: XP_032876572.1 or XP_032876571.1), *Amblyraja radiata* AGPAT1 (GenBank:

XP_032904997.1), *Amblyraja radiata* AGPAT3 (GenBank: XP_032888230.1), *Erpetoichthys calabaricus* AGPAT4 (GenBank: XP_028675971.1), *Betta splendens* AGPAT4 (GenBank: XP_029031236.1), *Oryzias melastigma* AGPAT3 (GenBank: KAF6723353.1), *Oncorhynchus mykiss* AGPAT5 (GenBank: XP_021436632.1), *Takifugu rubripes* AGPAT5 (GenBank: XP_003964213.1), *Gouania willdenowi* AGPAT5 (GenBank: XP_028324647.1), *Gadus morhua* AGPAT5 (GenBank: XP_030234890.1), *Gadus morhua* AGPAT4 (GenBank: XP_030234440.1 or XP_030234439.1), *Gadus morhua* AGPAT3 (GenBank: XP_030199943.1), *Gadus morhua* AGPAT1 (GenBank: XP_030209900.1), *Gadus morhua* LPGAT1 (GenBank: XP_030200859.1), *Ovis aries* AGPAT1 (GenBank: XP_011955824.1 or XP_004018969.1), *Ovis aries* LPCAT2 (GenBank: XP_004015039.1), *Ovis aries* AGPAT3 (GenBank: XP_014948165.1), *Ovis aries* AGPAT4 (GenBank: XP_027828439.1, XP_027828438.1, XP_027828437.1), *Ovis aries* AGPAT2 (GenBank: XP_027821958.1 or XP_014949598.2), *Ovis aries* AGPAT5 (GenBank: XP_027818538.1 or XP_027818539.1), and a LPAT having at least 70% sequence identity, preferably at least 80% sequence identity, and more preferably at least 90% sequence identity to any of the above listed heterologous LPATs.

In a preferred embodiment, the heterologous LPAT is selected from the group consisting of *Bos taurus* AGPAT4 (SEQ ID NO: 13, 14, or 15), *Bos taurus* AGPAT1 (SEQ ID NO: 16), *Bos taurus* AGPAT2 (SEQ ID NO: 17), *Bos taurus* AGPAT3 (SEQ ID NO: 18), *Bos taurus* AGPAT5 (SEQ ID NO: 19), *Arabidopsis thaliana* LPAT1 (SEQ ID NO: 20), *Brassica napus* LPAT1 (SEQ ID NO: 24), *Mycolicibacterium smegmatis* ERS451418_00313 (SEQ ID NO: 28), *Mycolicibacterium smegmatis* probable LPAT (SEQ ID NO: 29), *Mycolicibacterium smegmatis* ERS451418_06226 (SEQ ID NO: 30), *Mycolicibacterium smegmatis* ERS451418_02370 (SEQ ID NO: 31), *Mycolicibacterium smegmatis* ERS451418_05575 (SEQ ID NO: 32), *Mycolicibacterium smegmatis* ERS451418_04128 (SEQ ID NO: 33), *Mycolicibacterium smegmatis* ERS451418_06227 (SEQ ID NO: 34), *Mycolicibacterium smegmatis* BIN_B_00519 (SEQ ID NO: 35), *Mycolicibacterium smegmatis* D806_035910 (SEQ ID NO: 36), *Mycolicibacterium smegmatis* BIN_B_03706 (SEQ ID NO: 37), *Mycolicibacterium smegmatis* D806_003290 (SEQ ID NO: 38), *Cocos nucifera* probable LPAT (SEQ ID NO: 86) and a heterologous lysophosphatidyl acyltransferase having at least 70% sequence identity, preferably at least 80% sequence identity, and more preferably at least 90% sequence identity to any of SEQ ID NO: 13-20, 24, 28-38, 86. In a particular embodiment, the heterologous LPAT is selected from the group consisting of any of SEQ ID NO: 13-20, 24, 28-38, and a heterologous lysophosphatidyl acyltransferase having at least 70% sequence identity, preferably at least 80% sequence identity, and more preferably at least 90% sequence identity to any of SEQ ID NO: 13-20, 24, 28-38.

In a particular preferred embodiment, the heterologous LPAT is selected from the group consisting of *Bos taurus* AGPAT1 (SEQ ID NO: 16), and a heterologous LPAT having at least 70% sequence identity, preferably at least 80% sequence identity, and more preferably at least 90% sequence identity to SEQ ID NO: 16. In an embodiment, the heterologous LPAT is active on lysophosphatidic acids with a saturated fatty acid at the sn-1 position. In a preferred embodiment, the LPAT has preference for lysophosphatidic acids with a saturated fatty acid at the sn-1 position.

In some embodiments, the LPAT with activity on saturated fatty acyl-CoAs is localized to the endoplasmic reticulum, cytosol, or lipid body of the fungal cell. This is achieved through removal of localization signals to other subcellular compartments from the expressed LPAT, and/or addition of localization signals to the desired subcellular compartment to the amino acid sequence of the expressed LPAT.

A particular aspect relates to a fungal cell capable of producing triacylglycerols. The fungal cell is genetically modified for expression of a heterologous LPAT selected from the above mentioned groups of heterologous LPATs. In this particular aspect, the fungal cells is not genetically modified for overexpression of a triacylcelygerol lipase. In an embodiment, the fungal cell is capable of producing triacylgylcerols with saturated fatty acids.

In an embodiment, the fungal cell is genetically modified for expression of a heterologous GPAT that has activity on saturated fatty acyl-CoAs and is selected from the group consisting of *Bos taurus* GPAT4 isoform X1 (SEQ ID NO: 52), *Bos taurus* GPAT4 isoform X2 (SEQ ID NO: 53), *Bos taurus* GPAT2 (SEQ ID NO: 54), *Bos taurus* GPAT3 isoform X1 (SEQ ID NO: 55), *Bos taurus* GPAT3 isoform X2 (SEQ ID NO: 56), *Bos taurus* GPAT3 isoform X3 (SEQ ID NO: 57), *Bos taurus* GPAT3 isoform X4 (SEQ ID NO: 58), *Mus musculus* GPAT4 isoform X1 (SEQ ID NO: 59), *Homo sapiens* GPAT4 isoform 1 (GenBank: NP_001350126.1), *Homo sapiens* GPAT4 isoform 2 (GenBank: NP_001350127.1), *Homo sapiens* GPAM isoform X1 (SEQ ID NO: 60), *Lipomyces starkeyi* LIPSTDRAFT_235628 (GenBank: ODQ74991.1), *Theobroma cacao* GPAT1 (GenBank: E0X93017.1), *Theobroma cacao* GPAT3 (GenBank: E0X95331.1), *Theobroma cacao* GPAT8 (GenBank: XP_007051782.1), *Theobroma cacao* GPAT9 isoform 1 (GenBank: AQN67788.1), *Cucurbita moschata* ATS1;2 (SEQ ID NO: 61), *Leishmania major* GAT (GenBank: CBZ11971.1), *Homo sapiens* GPAT3 (SEQ ID NO: 62), *Helianthus annuus* PLSB (GenBank: ADV16382.1), *Mus musculus* GPAT2 (SEQ ID NO: 63), *Cavia porcellus* GPAM (GenBank: XP_003475176.1), *Cavia porcellus* GPAT4 (GenBank: XP_003464666.1), *Cavia porcellus* GPAT3 (GenBank: XP_003469448.1), *Sus scrofa* GPAM (UniProtKB/Swiss-Prot: F1S5L4, SV=3), *Sus scrofa* GPAT2 isoform X1 (GenBank: XP_020942711.1), *Sus scrofa* GPAT2 isoform X2 (GenBank: XP_020942714.1), *Sus scrofa* GPAT2 isoform X3 (GenBank: XP_013851296.1), *Sus scrofa* GPAT2 isoform X4 (GenBank: XP_020942715.1), *Sus scrofa* GPAT2 isoform X5 (GenBank: XP_020942716.1), *Sus scrofa* GPAT2 isoform X6 (GenBank: XP_020942717.1), *Sus scrofa* GPAT3 isoform X1 (GenBank: XP_003129395.1), *Sus scrofa* GPAT3 isoform X2 (GenBank: XP_020957460.1), *Sus scrofa* GPAT4 (GenBank: NP_001138491.1), *Rattus norvegicus* GPAT2 (UniProtKB/Swiss-Prot: D3ZI76, SV=1), *Theobroma cacao* TCM_016600 (UniProtKB/Swiss-Prot: A0A061G5W9, SV=1), *Theobroma cacao* TCM_021737 (UniProtKB/Swiss-Prot: A0A061ER03, SV=1), *Theobroma cacao* TCM_018071 (UniProtKB/Swiss-Prot: A0A061ELV3, SV=1), *Theobroma cacao* TCM_026783 (UniProtKB/Swiss-Prot: A0A061F4W6, SV=1), *Theobroma cacao* TCM_010070 (UniProtKB/Swiss-Prot: A0A061E6K6, SV=1), *Theobroma cacao* TCM_042716 (UniProtKB/Swiss-Prot: A0A061FTM4, SV=1), *Theobroma cacao* TCM_034985 (UniProtKB/Swiss-Prot: A0A061FNL5, SV=1), *Theobroma cacao* TCM_034986 (UniProtKB/Swiss-Prot: A0A061FFK6, SV=1), *Theobroma cacao* TCM_018993 (UniProtKB/Swiss-Prot: A0A061ENB8, SV=1), *Theobroma cacao* TCM_006479 (UniProtKB/Swiss-Prot: A0A061DXP4, SV=1), *Theobroma cacao* TCM_006479 (UniProtKB/Swiss-Prot: A0A061DXE4, SV=1), *Elaeis guineensis* GPAT (UniProtKB/Swiss-Prot: Q9M4V1, SV=1; Q9M425 SV=1), *Elaeis guineensis* GPAT3 (UniProtKB/Swiss-Prot: A0A346RPG0, SV=1), *Callithrix jacchus* GPAT4 isoform X3 (GenBank: XP_035126281.1), *Boleophthalmus pectinirostris* GPAT4 isoform X3 (GenBank: XP_020791091.1), *Notolabrus celidotus* LOC117831297 (GenBank: XP_034565815.1), *Ictidomys tridecemlineatus* GPAM (GenBank: XP_013211999.1), *Lacerta agilis* GPAM (GenBank: XP_033005584.1), *Astyanax mexicanus* GPAM (GenBank: XP_022524671.1), *Momordica charantia* LOC111025851 (GenBank: XP_022159428.1), *Rosa chinensis* LOC112176102 (GenBank: XP_024169692.1), *Dendrobium catenatum* LOC110106934 (GenBank: XP_020692692.1), *Cricetulus griseus* GPAT2 (GenBank: ERE69882.1), *Vicugna pacos* GPAT2 isoform X6 (GenBank: XP_031547910.1), *Terrapene carolina triunguis* GPAT2 (GenBank: XP_024067376.1), *Gallus gallus* GPAT3 isoform X1 (GenBank: XP_015131755.1), *Gallus gallus* GPAT3 isoform X2 (GenBank: XP_015131756.1), *Gallus gallus* GPAT2 isoform X1 (GenBank: XP_015128440.1), *Gallus gallus* GPAT2 isoform X2 (GenBank: XP_015128445.1), *Gallus gallus* GPAT2 isoform X3 (GenBank: XP_015128446.1), *Gallus gallus* GPAT2 isoform X4 (GenBank: XP_015128447.1), *Gallus gallus* GPAM isoform X1 (GenBank: XP_015144454.1), *Gallus gallus* GPAM isoform X2 (GenBank: XP_015144457.1), *Gallus gallus* GPAT4 (GenBank: XP_015152890.1), *Gallus gallus* AGPAT9 (UniProtKB/Swiss-Prot: Q5ZLL8, SV=1), *Ovis aries* GPAM isoform X1 (GenBank: XP_011958316.2), *Ovis aries* GPAM isoform X2 (GenBank: XP_011958318.2), *Ovis aries* GPAM isoform X3 (GenBank: XP_011958320.2), *Ovis aries* GPAT3 isoform X1 (GenBank: XP_027826951.1), *Ovis aries* GPAT3 isoform X2 (GenBank: XP_012035678.1), *Ovis aries* GPAT4 (GenBank: XP_004021847.1), *Ovis aries* GPAT2 (GenBank: XP_027822908.1), and a heterologous GPAT having at least 70% sequence identity, preferably at least 80% sequence identity, and more preferably at least 90% sequence identity to any of the above listed heterologous GPATs.

In a preferred embodiment, the heterologous GPAT is selected from the group consisting of *Bos taurus* GPAT4 isoform X1 (SEQ ID NO: 52), *Bos taurus* GPAT4 isoform X2 (SEQ ID NO: 53), *Bos taurus* GPAT2 (SEQ ID NO: 54), *Bos taurus* GPAT3 isoform X1 (SEQ ID NO: 55), *Bos taurus* GPAT3 isoform X2 (SEQ ID NO: 56), *Bos taurus* GPAT3 isoform X3 (SEQ ID NO: 57), *Bos taurus* GPAT3 isoform X4 (SEQ ID NO: 58), *Mus musculus* GPAT4 isoform X1 (SEQ ID NO: 59), *Homo sapiens* GPAM isoform X1 (SEQ ID NO: 60), *Cucurbita moschata* ATS1;2 (SEQ ID NO: 61), *Mus musculus* GPAT2 (SEQ ID NO: 63), and a heterologous glycerol-3-phosphate acyltransferase having at least 70% sequence identity, preferably at least 80% sequence identity, and more preferably at least 90% sequence identity to any of SEQ ID NO: 52-61, 63.

In some embodiments, the GPAT with activity on saturated fatty acyl-CoAs is localized to the endoplasmic reticulum, cytosol, or lipid body of the fungal cell. This is achieved through removal of localization signals to other subcellular compartments from the expressed GPAT, and/or addition of localization signals to the desired subcellular compartment to the amino acid sequence of the expressed GPAT.

A particular aspect relates to a fungal cell capable of producing triacylglycerols. The fungal cell is genetically modified for expression of a heterologous GPAT selected from the above mentioned groups of heterologous GPATs. In this particular aspect, the fungal cells is not genetically modified for overexpression of a triacylcelygerol lipase. In an embodiment, the fungal cell is capable of producing triacylgylcerols with saturated fatty acids.

In an embodiment, the fungal cell is genetically modified for expression of a heterologous DGAT that has activity on saturated fatty acyl-CoAs and is selected from the group consisting of *Brassica napus* DGAT1-1 (SEQ ID NO: 7), *Tropaeolum majus* DGAT (SEQ ID NO: 10), *Bos taurus* DGAT1 isoform X1 (SEQ ID NO: 64), *Bos taurus* DGAT1 isoform X2 (SEQ ID NO: 65), *Bos taurus* DGAT2 (SEQ ID NO: 66), *Bos taurus* DGAT2L6 (SEQ ID NO: 67), *Sus scrofa* DGAT1 isoform X1 (GenBank: XP_020944356.1), *Sus scrofa* DGAT1 isoform X2 (XP_005655368.2), *Sus scrofa* DGAT2 (GenBank: NP_001153552.1), *Sus scrofa* DGAT2L6 (GenBank: XP_020935502.1), *Vernicia fordii* DGAT1 (SEQ ID NO: 68), *Homo sapiens* DGAT2 (SEQ ID NO: 69), *Arachis hypogaea* DGAT3 (SEQ ID NO: 70), *Arabidopsis thaliana* DGAT1 (SEQ ID NO: 71), *Umbelopsis ramanniana* DGAT2A (UniProtKB/Swiss-Prot: Q96UY2, SV=1), *Umbelopsis ramanniana* DGAT2B (UniProtKB/Swiss-Prot: Q96UY1, SV=1), *Brassica napus* DGAT1.b (UniProtKB/Swiss-Prot: K9LLA9, SV=1), *Arabidopsis thaliana* DGAT1 (SEQ ID NO: 71), *Thraustochytrium aureum* DGAT2 (SEQ ID NO: 72), *Ovis aries* DGAT1 isoform X1 (GenBank: XP_027828547.1), *Ovis aries* DGAT1 isoform X1 (XP_027828548.1), *Theobroma cacao* TCM_037624 (SEQ ID NO: 73), *Theobroma cacao* DGAT2 isoform X1 (GenBank: XP_007046425.2), *Theobroma cacao* DGAT2 isoform X2 (GenBank: XP_007046427.2), *Theobroma cacao* DGAT1 isoform X1 (GenBank: XP_007012779.2), *Theobroma cacao* DGAT1 isoform X2 (GenBank: XP_017982745.1), *Elaeis guineensis* DGAT1-2 isoform X1 (GenBank: XP_010925471.1), *Elaeis guineensis* DGAT1-2 isoform X2 (GenBank: XP_010925472.1), *Elaeis guineensis* DGAT1-2 isoform X3 (GenBank: XP_010925473.1), *Elaeis guineensis* DGAT1-2 isoform X4 (GenBank: XP_010925474.1), *Elaeis guineensis* LOC105052865 (GenBank: XP_010932136.1), *Elaeis guineensis* LOC105043901 (GenBank: XP_029120027.1), *Elaeis guineensis* LOC105040465 (GenBank: XP_029119023.1), *Elaeis guineensis* LOC105047643 (GenBank: XP_010924968.1), *Elaeis guineensis* LOC105040102 (GenBank: XP_010914783.1), *Elaeis guineensis* LOC105035148 (GenBank: XP_010908889.1), *Gallus gallus* DGAT2 (GenBank: XP_419374.3), *Gallus gallus* LOC112533497 isoform X1 (GenBank: XP_025011345.1), *Gallus gallus* LOC112533497 (GenBank: XP_025011346.1), *Pelodiscus sinensis* DGAT2 isoform X1 (GenBank: XP_006133639.1), *Anguilla anguilla* DGAT2 (GenBank: XP_035289346.1), *Oreochromis niloticus* DGAT2 (GenBank: XP_003459020.1), *Arachis hypogaea* DGAT3 (GenBank: XP_025643095.1), *Abrus precatorius* DGAT3 (GenBank: XP_027331091.1), *Syzygium oleosum* DGAT3 (GenBank: XP_030472906.1), *Raphanus sativus* DGAT1 (GenBank: XP_018452552.1), *Momordica charantia* DGAT1A (GenBank: XP_022154718.1), *Morella rubra* DGAT1 (GenBank: KAB1209353.1), and a heterologous DGAT having at least 70% sequence identity, preferably at least 80% sequence identity, and more preferably at least 90% sequence identity to any of the above listed heterologous DGATs.

In a preferred embodiment, the heterologous DGAT is selected from the group consisting of *Brassica napus* DGAT1-1 (SEQ ID NO: 7), *Tropaeolum majus* DGAT (SEQ ID NO: 10), *Bos taurus* DGAT1 isoform X1 (SEQ ID NO: 64), *Bos taurus* DGAT1 isoform X2 (SEQ ID NO: 65), *Bos taurus* DGAT2 (SEQ ID NO: 66), *Bos taurus* DGAT2L6 (SEQ ID NO: 67), *Homo sapiens* DGAT2 (SEQ ID NO: 69), *Arachis hypogaea* DGAT3 (SEQ ID NO: 70), *Arabidopsis thaliana* DGAT1 (SEQ ID NO: 71), *Thraustochytrium aureum* DGAT2 (SEQ ID NO: 72), and a heterologous diacylglycerol acyltransferase having at least 70% sequence identity, preferably at least 80% sequence identity, and more preferably at least 90% sequence identity to any of SEQ ID NO: 7, 10, 64-67, 69-72. In particular embodiment, the heterologous DGAT is selected from the group consisting of any of SEQ ID NO: 7, 10, 64-67, 69-70, 72, and a heterologous diacylglycerol acyltransferase having at least 70% sequence identity, preferably at least 80% sequence identity, and more preferably at least 90% sequence identity to any of SEQ ID NO: 7, 10, 64-67, 69-70, 72.

In an embodiment, the heterologous DGAT is active on diacylglycerols with saturated fatty acids at the sn-1 and/or sn-2 positions. In a preferred embodiment, the DGAT has preference for diacylglycerols with saturated fatty acids at the sn-1 and/or sn-2 positions.

In some embodiments, the DGAT with activity on saturated fatty acyl-CoAs is localized to the endoplasmic reticulum, cytosol, or lipid body of the fungal cell. This is achieved through removal of localization signals to other subcellular compartments from the expressed DGAT, and/or addition of localization signals to the desired subcellular compartment to the amino acid sequence of the expressed DGAT.

A particular aspect relates to a fungal cell capable of producing triacylglycerols. The fungal cell is genetically modified for expression of a heterologous DGAT selected from the above mentioned groups of heterologous DGATs. In this particular aspect, the fungal cells is not genetically modified for overexpression of a triacylcelygerol lipase. In an embodiment, the fungal cell is capable of producing triacylgylcerols with saturated fatty acids.

In an embodiment, the fungal cell is genetically modified for overexpression of a triacylglycerol lipase with preference for unsaturated fatty acids. In an embodiment, the triacylglycerol lipase is selected from the group consisting of *Homo sapiens* PNLIP (SEQ ID NO: 11), *Yarrowia lipolytica* Lip2 (SEQ ID NO: 12), *Diutina rugosa* LIP1 (SEQ ID NO: 39), *Streptomyces rimosus* CP984_RS32550 (SEQ ID NO: 40), *Geotrichum candidum* LIP1 (SEQ ID NO: 41), *Geotrichum candidum* LIP2 (SEQ ID NO: 42), *Streptomyces coelicolor* LIP1 (SEQ ID NO: 43), *Ricinus communis* OBL1 (SEQ ID NO: 44), *Amycolatopsis mediterranei* AMED_3680 (SEQ ID NO: 45), *Thermosyntropha lipolytica* SAMN02745221_00755 (SEQ ID NO: 46), *Thermosyntropha lipolytica* SAMN02745221_00138 (SEQ ID NO: 47), *Penaeus vannamei* C7M84_014708 (SEQ ID NO: 48), *Oryza sativa Japonica* grp. P0625E02.112 (SEQ ID NO: 49), *Ricinus communis* LipRC1p (GeneBank accession: ABD90510.1), *Ricinus communis* RCOM_0994070 (GeneBank accession: EEF29057.1), *Populus alba* D5086_0000161650 (GeneBank accession: TKS02461.1), *Geotrichum fermentans* lipase (GeneBank accession: AIN94968.1), *Diutina rugosa* LIP4 (UniProtKB/Swiss-Prot: P32948, SV=1), *Fusarium flagelliforme* FIE12Z_6310 (GeneBank accession: RFN49415.1), *Candida* sp. AC-II™ AET41734.1 (GeneBank accession: AET41734.1), *Diutina rugosa* LIPJ08 (GeneBank accession: ACN78942.1),

*Trichoderma gamsii* TGAM01_v205837 (GeneBank accession: XP_024405489.1), *Theobroma cacao* TCM_029266 (GeneBank accession: EOY27419.1), *Populus tomentosa* lipase (GeneBank accession: AFZ78667.1), *Solanum lycopersicum* LeLID1 (SEQ ID NO: 50), *Capsicum baccatum* CQW23_29984 (GeneBank accession: PHT30390.1), *Capsicum annuum* T459_05088 (GeneBank accession: XP_016559794.1), *Mucuna pruriens* DSEL (GeneBank accession: RDX62039.1), *Triticum urartu* TRIUR3_31903 (GeneBank accession: EMS63185.1), *Pseudozyma aphidis* LIPA (SEQ ID NO: 51), *Kurtzmanomyces* sp. LIP (GeneBank accession: BAB91331.1), *Ustilago maydis* UMAG_11070 (GeneBank accession: XP_011390077.1), *Violaceomyces palustris* LIPA (GeneBank accession: PWN48207.1), *Acaromyces ingoldii* FA10DRAFT_265027 (GeneBank accession: XP_025378345.1), *Amycolatopsis mediterranei* U32 lipase AMED_7492 (SEQ ID NO: 105), *Geotrichum candidum* Q0MVP3 (SEQ ID NO: 111), *Geotrichum candidum* LIP1 (SEQ ID NO: 41), and a triacylglycerol lipase having at least 70% sequence identity, preferably at least 80% sequence identity, and more preferably at least 90% sequence identity to any of the above listed triacylglycerol lipases.

In an embodiment, the triacylglycerol lipase with preference for unsaturated fatty acids is expressed without a secretion signal. Secretion signals within amino acid sequences can be detected using SignalP 5.0 (Almagro Armenteros et al, 2019), Signal-BLAST (Franks and Sippl, 2008), or PrediSi.

In a preferred embodiment, the triacylglycerol lipase is selected from the group consisting of *Homo sapiens* PNLIP (SEQ ID NO: 11), *Yarrowia lipolytica* Lip2 (SEQ ID NO: 12), *Diutina rugosa* LIP1 (SEQ ID NO: 39), *Streptomyces rimosus* CP984_RS32550 (SEQ ID NO: 40), *Geotrichum candidum* LIP1 (SEQ ID NO: 41), *Geotrichum candidum* LIP2 (SEQ ID NO: 42), *Streptomyces coelicolor* LIP1 (SEQ ID NO: 43), *Amycolatopsis mediterranei* AMED_3680 (SEQ ID NO: 45), *Penaeus vannamei* C7M84_014708 (SEQ ID NO: 48), *Solanum lycopersicum* LeLID1 (SEQ ID NO: 50), *Pseudozyma aphidis* LIPA (SEQ ID NO: 51), and a triacylglycerol lipase having at least 70% sequence identity, preferably at least 80% sequence identity, and more preferably at least 90% sequence identity to any of SEQ ID NO: 11-12, 39-43, 54, 48, 50-51.

In an embodiment, the triacylglycerol lipase acts on the sn-113 positions of the triacylglycerol. In another embodiment the triacylglycerol lipase acts on the sn-2 position of the triacylglycerol.

In an embodiment, the fungal cell is genetically modified for overexpression a triacylglycerol lipase having higher lipase activity on unsaturated fatty acids on triacylglycerols compared to saturated fatty acids, such as any of the triacylglycerol lipases mentioned above, and for expression of a heterologous GPAT with activity, preferably preference, for saturated fatty acyl-CoAs, such as any of the GPAT mentioned above.

In another embodiment, the fungal cell is genetically modified for overexpression of a triacylglycerol lipase having higher lipase activity on unsaturated fatty acids on triacylglycerols compared to saturated fatty acids, such as any of the triacylglycerol lipases mentioned above, and for expression of a heterologous DGAT with activity, preferably preference, for saturated fatty acyl-CoAs, such as any of the DGAT mentioned above.

In a further embodiment, the fungal cell is genetically modified for overexpression a triacylglycerol lipase having higher lipase activity on unsaturated fatty acids on triacylglycerols compared to saturated fatty acids, such as any of the triacylglycerol lipases mentioned above, and for expression of a heterologous LPAT with activity, preferably preference, for saturated fatty acyl-CoAs, such as any of the LPAT mentioned above.

In yet another embodiment, the fungal cell is genetically modified for overexpression of a triacylglycerol lipase having higher lipase activity on unsaturated fatty acids on triacylglycerols compared to saturated fatty acids, such as any of the triacylglycerol lipases mentioned above, for expression of a heterologous GPAT with activity, preferably preference, for saturated fatty acyl-CoAs, such as any of the GPAT mentioned above and for expression of a heterologous DGAT with activity, preferably preference, for saturated fatty acyl-CoAs, such as any of the DGAT mentioned above.

In an embodiment, the fungal cell is genetically modified for overexpression of a triacylglycerol lipase having higher lipase activity on unsaturated fatty acids on triacylglycerols compared to saturated fatty acids, such as any of the triacylglycerol lipases mentioned above, for expression of a heterologous GPAT with activity, preferably preference, for saturated fatty acyl-CoAs, such as any of the GPAT mentioned above and for expression of a heterologous LPAT with activity, preferably preference, for saturated fatty acyl-CoAs, such as any of the LPAT mentioned above.

In another embodiment, the fungal cell is genetically modified for overexpression of a triacylglycerol lipase having higher lipase activity on unsaturated fatty acids on triacylglycerols compared to saturated fatty acids, such as any of the triacylglycerol lipases mentioned above, for expression of a heterologous DGAT with activity, preferably preference, for saturated fatty acyl-CoAs, such as any of the DGAT mentioned above and for expression of a heterologous LPAT with activity, preferably preference, for saturated fatty acyl-CoAs, such as any of the LPAT mentioned above.

In a further embodiment, the fungal cell is genetically modified for overexpression of a triacylglycerol lipase having higher lipase activity on unsaturated fatty acids on triacylglycerols compared to saturated fatty acids, such as any of the triacylglycerol lipases mentioned above, for expression of a heterologous GPAT with activity, preferably preference, for saturated fatty acyl-CoAs, such as any of the GPAT mentioned above, for expression of a heterologous DGAT with activity, preferably preference, for saturated fatty acyl-CoAs, such as any of the DGAT mentioned above and for expression of a heterologous LPAT with activity, preferably preference, for saturated fatty acyl-CoAs, such as any of the LPAT mentioned above.

In a preferred embodiment, the fungal cell is *Saccharomyces cerevisiae* or *Yarrowia lipolytica* and is genetically modified for:

expression of a heterologous LPAT selected from the group consisting of *Bos taurus* AGPAT4 (SEQ ID NO: 13, 14, or 15), *Bos taurus* AGPAT1 (SEQ ID NO: 16), *Bos taurus* AGPAT2 (SEQ ID NO: 17), *Bos taurus* AGPAT3 (SEQ ID NO: 18), *Bos taurus* AGPAT5 (SEQ ID NO: 19), *Arabidopsis thaliana* LPAT1 (SEQ ID NO: 20), *Brassica napus* LPAT1 (SEQ ID NO: 24), *Mycolicibacterium smegmatis* ERS451418_00313 (SEQ ID NO: 28), *Mycolicibacterium smegmatis* Probable LPAT (SEQ ID NO: 29), *Mycolicibacterium smegmatis* ERS451418_06226 (SEQ ID NO: 30), *Mycolicibacterium smegmatis* ERS451418_02370 (SEQ ID NO: 31), *Mycolicibacterium smegmatis* ERS451418_05575 (SEQ ID NO: 32), *Mycolicibacterium smegmatis* ERS451418_04128 (SEQ ID NO: 33), *Mycolicibacterium smegmatis* ERS451418_06227

(SEQ ID NO: 34), *Mycolicibacterium smegmatis* BIN_B_00519 (SEQ ID NO: 35), *Mycolicibacterium smegmatis* D806_035910 (SEQ ID NO: 36), *Mycolicibacterium smegmatis* BIN_B_03706 (SEQ ID NO: 37), *Mycolicibacterium smegmatis* D806_003290 (SEQ ID NO: 38), and a heterologous LPAT having at least 70% sequence identity, preferably at least 80% sequence identity, and more preferably at least 90% sequence identity to any of SEQ ID NO: 13-20, 24, 28-38; and expression of a triacylglycerol lipase selected from the group consisting of *Homo sapiens* PNLIP (SEQ ID NO: 11), *Yarrowia lipolytica* Lip2 (SEQ ID NO: 12), *Diutina rugosa* LIP1 (SEQ ID NO: 39), *Streptomyces rimosus* CP984_RS32550 (SEQ ID NO: 40), *Geotrichum candidum* LIP1 (SEQ ID NO: 41), *Geotrichum candidum* LIP2 (SEQ ID NO: 42), *Streptomyces coelicolor* LIP1 (SEQ ID NO: 43), *Amycolatopsis mediterranei* AMED_3680 (SEQ ID NO: 45), *Penaeus vannamei* C7M84_014708 (SEQ ID NO: 48), *Solanum lycopersicum* LeLID1 (SEQ ID NO: 50), *Pseudozyma aphidis* LIPA (SEQ ID NO: 51), and a triacylglycerol lipase having at least 70% sequence identity, preferably at least 80% sequence identity, and more preferably at least 90% sequence identity to any of SEQ ID NO: 39-11-12, 39-43, 45, 48, 50-51.

In another preferred embodiment the fungal cell is *Saccharomyces cerevisiae* or *Yarrowia lipolytica* and is genetically modified for:

expression of a heterologous GPAT selected from a group consisting of *Bos taurus* GPAT4 isoform X1 (SEQ ID NO: 52), *Bos taurus* GPAT4 isoform X2 (SEQ ID NO: 53), *Bos taurus* GPAT2 (SEQ ID NO: 54), *Bos taurus* GPAT3 isoform X1 (SEQ ID NO: 55), *Bos taurus* GPAT3 isoform X2 (SEQ ID NO: 56), *Bos taurus* GPAT3 isoform X3 (SEQ ID NO: 57), *Bos taurus* GPAT3 isoform X4 (SEQ ID NO: 58), *Mus musculus* GPAT4 isoform X1 (SEQ ID NO: 59), *Homo sapiens* GPAM isoform X1 (SEQ ID NO: 60), *Cucurbita moschata* ATS1;2 (SEQ ID NO: 61), *Mus musculus* GPAT2 (SEQ ID NO: 63), and a heterologous GPAT having at least 70% sequence identity, preferably at least 80% sequence identity, and more preferably at least 90% sequence identity to any of SEQ ID NO: 52-61, 63; and expression of a triacylglycerol lipase selected from the group consisting of *Bos taurus* AGPAT4 (SEQ ID NO: 13, 14, or 15), *Bos taurus* AGPAT1 (SEQ ID NO: 16), *Bos taurus* AGPAT2 (SEQ ID NO: 17), *Bos taurus* AGPAT3 (SEQ ID NO: 18), *Bos taurus* AGPAT5 (SEQ ID NO: 19), *Arabidopsis thaliana* LPAT1 (SEQ ID NO: 20), *Brassica napus* LPAT1 (SEQ ID NO: 24), *Mycolicibacterium smegmatis* ERS451418_00313 (SEQ ID NO: 28), *Mycolicibacterium smegmatis* probable LPAT (SEQ ID NO: 29), *Mycolicibacterium smegmatis* ERS451418_06226 (SEQ ID NO: 30) *Mycolicibacterium smegmatis* ERS451418_02370 (SEQ ID NO: 31), *Mycolicibacterium smegmatis* ERS451418_05575 (SEQ ID NO: 32), *Mycolicibacterium smegmatis* ERS451418_04128 (SEQ ID NO: 33), *Mycolicibacterium smegmatis* ERS451418_06227 (SEQ ID NO: 34), *Mycolicibacterium smegmatis* BIN_B_00519 (SEQ ID NO: 35), *Mycolicibacterium smegmatis* D806_035910 (SEQ ID NO: 36), *Mycolicibacterium smegmatis* BIN_B_03706 (SEQ ID NO: 37) and *Mycolicibacterium smegmatis* D806_003290 (SEQ ID NO: 38), and a triacylglycerol lipase having at least 70% sequence identity, preferably at least 80% sequence identity, and more preferably at least 90% sequence identity to any of SEQ ID NO: 13-20, 24, 28-38.

In a further preferred embodiment, the fungal cell is *Saccharomyces cerevisiae* or *Yarrowia lipolytica* and is genetically modified for:

expression of a triacylglycerol lipase selected from the group consisting of *Homo sapiens* PNLIP (SEQ ID NO: 11), *Yarrowia lipolytica* Lip2 (SEQ ID NO: 12), *Diutina rugosa* LIP1 (SEQ ID NO: 39), *Streptomyces rimosus* CP984_RS32550 (SEQ ID NO: 40), *Geotrichum candidum* LIP1 (SEQ ID NO: 41), *Geotrichum candidum* LIP2 (SEQ ID NO: 42), *Streptomyces coelicolor* LIP1 (SEQ ID NO: 43), *Amycolatopsis mediterranei* AMED_3680 (SEQ ID NO: 45), *Penaeus vannamei* C7M84_014708 (SEQ ID NO: 48), *Solanum lycopersicum* LeLID1 (SEQ ID NO: 50), *Pseudozyma aphidis* LIPA (SEQ ID NO: 51), and a triacylglycerol lipase having at least 70% sequence identity, preferably at least 80% sequence identity, and more preferably at least 90% sequence identity to any of SEQ ID NO: 39-11-12, 39-43, 45, 48, 50-51; and expression of a heterologous GPAT, LPAT, and/or DGAT, wherein:

the heterologous GPAT is selected from the group consisting of *Bos taurus* GPAT4 isoform X1 (SEQ ID NO: 52), *Bos taurus* GPAT4 isoform X2 (SEQ ID NO: 53), *Bos taurus* GPAT2 (SEQ ID NO: 54), *Bos taurus* GPAT3 isoform X1 (SEQ ID NO: 55), *Bos taurus* GPAT3 isoform X2 (SEQ ID NO: 56), *Bos taurus* GPAT3 isoform X3 (SEQ ID NO: 57), *Bos taurus* GPAT3 isoform X4 (SEQ ID NO: 58), *Mus musculus* GPAT4 isoform X1 (SEQ ID NO: 59), *Homo sapiens* GPAM isoform X1 (SEQ ID NO: 60), *Cucurbita moschata* ATS1;2 (SEQ ID NO: 61), *Mus musculus* GPAT2 (SEQ ID NO: 63), and a heterologous GPAT having at least 70% sequence identity, preferably at least 80% sequence identity, and more preferably at least 90% sequence identity to any of SEQ ID NO: 52-61, 63;

the heterologous LPAT is selected from the group consisting of *Bos taurus* AGPAT4 (SEQ ID NO: 13, 14, or 15), *Bos taurus* AGPAT1 (SEQ ID NO: 16), *Bos taurus* AGPAT2 (SEQ ID NO: 17), *Bos taurus* AGPAT3 (SEQ ID NO: 18), *Bos taurus* AGPAT5 (SEQ ID NO: 19), *Arabidopsis thaliana* LPAT1 (SEQ ID NO: 20), *Brassica napus* LPAT1 (SEQ ID NO: 24), *Mycolicibacterium smegmatis* ERS451418_00313 (SEQ ID NO: 28), *Mycolicibacterium smegmatis* Probable LPAT (SEQ ID NO: 29), *Mycolicibacterium smegmatis* ERS451418_06226 (SEQ ID NO: 30), *Mycolicibacterium smegmatis* ERS451418_02370 (SEQ ID NO: 31), *Mycolicibacterium smegmatis* ERS451418_05575 (SEQ ID NO: 32), *Mycolicibacterium smegmatis* ERS451418_04128 (SEQ ID NO: 33), *Mycolicibacterium smegmatis* ERS451418_06227 (SEQ ID NO: 34), *Mycolicibacterium smegmatis* BIN_B_00519 (SEQ ID NO: 35), *Mycolicibacterium smegmatis* D806_035910 (SEQ ID NO: 36), *Mycolicibacterium smegmatis* BIN_B_03706 (SEQ ID NO: 37), *Mycolicibacterium smegmatis* D806_003290 (SEQ ID NO: 38), and a heterologous LPAT having at least 70% sequence identity, preferably at least 80% sequence identity, and more preferably at least 90% sequence identity to any of SEQ ID NO: 13-20, 24, 28-38;

the heterologous DGAT is selected from the group consisting of *Brassica napus* DGAT1-1 (SEQ ID NO: 7), *Tropaeolum majus* DGAT (SEQ ID NO: 10), *Bos taurus* DGAT1 isoform X1 (SEQ ID NO: 64), *Bos taurus* DGAT1 isoform X2 (SEQ ID NO: 65), *Bos taurus* DGAT2 (SEQ ID NO: 66), *Bos taurus* DGAT2L6 (SEQ ID NO: 67), *Homo sapiens* DGAT2 (SEQ ID NO: 69), *Arachis hypogaea* DGAT3 (SEQ ID NO: 70), *Thraustochytrium aureum* DGAT2 (SEQ ID NO: 72), and a heterologous DGAT having at least 70% sequence identity, preferably at least 80% sequence identity, and more preferably at least 90% sequence identity to any of SEQ ID NO: 7, 10, 64-67, 69-70, 72.

In an embodiment, the fungal cell is genetically modified for expression of a heterologous phospholipase A2. In an embodiment, the phospholipase A2 is selected from the group consisting of *Rattus novegicus* Pla2g2a (SEQ ID NO: 74), *Rattus norvegicus* Pla2g5 (SEQ ID NO: 75), *Mus musculus* Pla2g5 (SEQ ID NO: 76), *Mus musculus* Pla2g2e (SEQ ID NO: 77), *Arabidopsis thaliana* PLA2-ALPHA (SEQ ID NO: 78), *Homo sapiens* PLA2G2E (UniProtKB/Swiss-Prot: Q9NZK7, SV=1), *Homo sapiens* PLA2G15 (UniProtKB/Swiss-Prot: Q8NCC3, SV=1), *Homo sapiens* PNPLA2 (UniProtKB/Swiss-Prot: Q96AD5, SV=1), *Mus musculus* PNPLA2 (SEQ ID NO: 79), *Arvicanthis niloticus* Pla2g2a (GenBank: XP_034358424.1), *Mus caroli* Pla2g2a (SEQ ID NO: 347), *Equus caballus* Pla2g2a (GenBank: XP_023482141.1), *Fukomys damarensis* H920_19479 (GenBank: XP_010612552.1), *Phascolarctos cinereus* LOC110198733 (GenBank: XP_020828848.1), *Pelodiscus sinensis* PLA2G5 (GenBank: XP_025045272.1), *Gallus gallus* Pla2g2a (GenBank: NP_001264843.1), *Mastomys coucha* Pla2g2d (GenBank: XP_031235076.1), *Mastomys coucha* Pla2g5 (GenBank: XP_031235078.1), *Ictidomys tridecemlineatus* Pla2g5 (GenBank: XP_021589594.1), *Canis lupus familiaris* PLA2G5 (GenBank: XP_003433800.1), *Mustela erminea* PLA2G5 (GenBank: XP_032158188.1), *Tupaia chinensis* PNPLA2 (GenBank: XP_027622478.1), *Mus musculus* PNPLA2 (GenBank: NP_001157161.1), *Struthidea cinereal* PLPL2 (GenBank: NXB57247.1), *Scleropages formosus* pnpla2 (GenBank: XP_029112005.1), and a phospholipase A2 having at least 70% sequence identity, preferably at least 80% sequence identity, and more preferably at least 90% sequence identity to any of the above listed heterologous phospholipases.

In an embodiment, the phospholipase is expressed without a secretion signal. Secretion signals within amino acid sequences can be detected using SignalP 5.0 (Almagro Armenteros et al, 2019), Signal-BLAST (Franks and Sippl, 2008), or PrediSi.

In a preferred embodiment, the phospholipase A2 is belongs to the group phospholipase A2 group IIA. In a preferred embodiment, the phospholipase A2 has preference for unsaturated acyl-CoA chains at sn-2 position. In a preferred embodiment, the phospholipase A2 has preference for phosphatidate.

In an embodiment, the fungal cell is capable of producing lipids that are at least 30%, preferably at least 40%, and more preferably at least 50% saturated. In an embodiment, the fungal cell is capable of producing triacylglycerols that are at least 30%, preferably at least 40%, and more preferably at least 50% saturated.

In an embodiment, the fungal cell is capable of producing lipids that comprises at least 10%, at least 15%, at least 20%, at least 25%, at least 30%, at least 35%, at least 40%, at least 45%, at least 50%, at least 55% or at least 60% palmitic acid per total lipids.

In an embodiment, the fungal cell with any of the modifications above is producing triacylglycerols that comprise 25-50% oleic acid, 15-25% stearic acid, 20-30% palmitic acid, and 0-15% palmitoleic acid per total triacylglycerols.

In an embodiment, the fungal cell is capable of producing lipids that comprise at least 10%, at least 15%, at least 20%, at least 25%, at least 30%, at least 35%, at least 40%, at least 45%, at least 50% or at least 60% stearic acid per total lipids.

In an embodiment, the fungal cell is capable of producing triacylglycerols that comprise at least 10%, at least 15%, at least 20%, at least 25%, at least 30%, at least 35%, at least 40%, at least 45%, at least 50% or at least 60% stearic acid per total triacylglycerols. In an embodiment, the fungal cell is capable of producing lipids that comprise 25-50% oleic acid, 15-25% stearic acid, 20-30% palmitic acid, and 0-15% palmitoleic acid per total lipids.

In an embodiment, the fungal cell is capable of producing triacylglycerols that comprise at least 10%, at least 15%, at least 20%, at least 25%, at least 30%, at least 35%, at least 40%, at least 45%, at least 50%, at least 55% or at least 60% palmitic acid per total triacylglycerols.

In some embodiments, the fungal cell is genetically modified to increase production of fats that are similar to animal dairy fats. This includes modifications to increase the content of triacylglycerol molecular species that contain short or medium-chain fatty acids.

In an embodiment, the at least one heterologous enzyme is capable of esterifying the triacylglycerol precursor with a short or medium-chain fatty acyl-CoA. In this embodiment, the triacylglycerol lipase has lower lipase activity on short and/or medium-chain fatty acids of triacylglycerols compared to long-chain fatty acids.

Hence, an aspect of the invention relates to a fungal cell capable of producing triacylglycerols. The fungal cell is genetically modified for overexpression of a triacylglycerol lipase and the fungal cell is genetically modified for expression of at least one heterologous enzyme selected from the group consisting of GPAT, LPAT and DGAT. In this aspect, the at least one heterologous enzyme is capable of esterifying a triacylglycerol precursor with a short or medium-chain fatty acyl-CoA and the triacylglycerol lipase has lower lipase activity on medium and/or short-chain fatty acids of triacylglycerols compared to long-chain fatty acids.

In this aspect, the at least one heterologous enzyme is capable of introducing short and/or medium-chain fatty acids at the triacylglycerol precursor to thereby obtain triacylglycerol molecules with one or more such short and/or medium-chain fatty acids. In addition, the triacylglycerol lipase has lower lipase activity on short and/or medium fatty acids as compared to long-chain fatty acids. This means that the triacylglycerol lipase thereby preferentially removes long-chain fatty acids from triacylglycerol molecules while leaving any short and/or medium-chain fatty acids. The removal of a long-chain fatty acid from triacylglycerol molecules implies that the sn position of the triacylglycerol molecule, from which the long-chain fatty acid was removed by the triacylglycerol lipase, is now available for esterification to enable addition of a short or medium-chain fatty acid. Hence, these combined enzymatic actions lead to an enrichment of triacylglycerol species with one or more short and/or medium-chain fatty acids.

In a particular embodiment, the at least one heterologous enzyme has preference for esterifying the triacylglycerol precursor with a short and/or medium fatty acyl-CoA over esterifying the triacylglycerol precursor with a long-chain fatty acyl-CoA. This means that the at least one heterologous enzyme preferentially adds a short and/or medium fatty acyl-CoA over a long-chain fatty acyl-CoA to the triacylglycerol precursor.

In an embodiment, the fungal cell is genetically modified for expression of a heterologous GPAT that has activity on short and/or medium-chain fatty acyl-CoAs and is selected from the group consisting of *Bos taurus* GPAT4 isoform X1 (SEQ ID NO: 52), *Bos taurus* GPAT4 isoform X2 (SEQ ID NO: 53), *Cocos nucifera* GPAT9 (SEQ ID NO: 80), *Bos taurus* GPAM (SEQ ID NO: 81), *Elaeis guineensis* GPAT (UniProtKB/Swiss-Prot: Q9M4V1, SV=1; Q9M425 SV=1), *Elaeis guineensis* GPAT3 (UniProtKB/Swiss-Prot: A0A346RPG0, SV=1), *Elaeis guineensis* probable GPAT (GenBank: XP_010938208.1), *Elaeis guineensis* probable GPAT (GenBank: XP_010904862.2), *Elaeis guineensis* GPAT5 (GenBank: XP_010906597.1), *Elaeis guineensis* GPAT1 (GenBank: XP_010924314.1), *Elaeis guineensis* probable GPAT (GenBank: XP_010940493.1), *Cocos nucifera* GPAT (SEQ ID NO: 82-85), and a heterologous GPAT having at least 70% sequence identity, preferably at least 80% sequence identity, and more preferably at least 90% sequence identity to any of the above listed heterologous GPATs.

In a preferred embodiment, the heterologous GPAT is selected from the group consisting of *Bos taurus* GPAT4 isoform X1 (SEQ ID NO: 52), *Bos taurus* GPAT4 isoform X2 (SEQ ID NO: 53), *Cocos nucifera* GPAT9 (SEQ ID NO: 80), *Bos taurus* GPAM (SEQ ID NO: 81), and a heterologous glycerol-3-phosphate acyltransferase having at least 70% sequence identity, preferably at least 80% sequence identity, and more preferably at least 90% sequence identity to any of SEQ ID NO: 52-53, 80-81.

In some embodiments, the GPAT with activity on medium and/or short-chain fatty acyl-CoAs is localized to the endoplasmic reticulum, cytosol, or lipid body of the fungal cell. This is achieved through removal of localization signals to other subcellular compartments from the expressed GPAT, and/or addition of localization signals to the desired subcellular compartment to the amino acid sequence of the expressed GPAT.

A particular aspect relates to a fungal cell capable of producing triacylglycerols. The fungal cell is genetically modified for expression of a heterologous GPAT selected from the above mentioned groups of heterologous GPATs. In this particular aspect, the fungal cells is not genetically modified for overexpression of a triacylcelygerol lipase. In an embodiment, the fungal cell is capable of producing triacylgylcerols with short and/or medium-chain fatty acids.

In an embodiment, the fungal cell is genetically modified for expression of a heterologous LPAT that has activity on short and/or medium-chain fatty acyl-CoAs and is selected from the group consisting *Bos taurus* AGPAT4 (SEQ ID NO: 13, 14, or 15), *Bos taurus* AGPAT1 (SEQ ID NO: 16), *Bos taurus* AGPAT2 (SEQ ID NO: 17), *Bos taurus* AGPAT3 (SEQ ID NO: 18), *Bos taurus* AGPAT5 (SEQ ID NO: 19), *Elaeis guineensis* LPAT4 (GenBank: XP_010936132.1), *Elaeis guineensis* LPAT (GenBank: XP_010908896.1), *Elaeis guineensis* LPAT (GenBank: XP_010908895.1), *Elaeis guineensis* LPAT1 (GenBank: XP_010919015.1), *Elaeis guineensis* PLS1 (GenBank: XP_010906759.1), *Elaeis guineensis* PLS1-like (GenBank: XP_010909860.2), *Elaeis guineensis* probable LPAT (GenBank: XP_029122716.1), *Elaeis guineensis* probable LPAT (GenBank: XP_029122715.1), *Elaeis guineensis* LPEAT1 (GenBank: XP_010905684.1, XP_010905687.1, XP_010905686.1, XP_010905685.1, XP_029124048.1, or XP_010938317.1), *Elaeis guineensis* LPEAT2 (GenBank: XP_010907482.1), *Cocos nucifera* probable LPAT (SEQ ID NO: 86), *Cuphea viscosissima* LPAT2 (SEQ ID NO: 87), *Cuphea avigera* var. *pulcherrima* LPAT2a (SEQ ID NO: 88), *Cuphea avigera* var. *pulcherrima* LPATB (SEQ ID NO: 89), *Cocos nucifera* putative LPAT (SEQ ID NO: 90-94), and a heterologous LPAT having at least 70% sequence identity, preferably at least 80% sequence identity, and more preferably at least 90% sequence identity to any of any of the above listed heterologous LPATs.

In a preferred embodiment, the heterologous LPAT is selected from the group consisting of *Bos taurus* AGPAT3 (SEQ ID NO: 18), *Bos taurus* AGPAT5 (SEQ ID NO: 19), *Cocos nucifera* probable LPAT (SEQ ID NO: 86), *Cuphea viscosissima* LPAT2 (SEQ ID NO: 87), *Cuphea avigera* var. *pulcherrima* LPAT2a (SEQ ID NO: 88), *Cuphea avigera* var. *pulcherrima* LPATB (SEQ ID NO: 89), and a heterologous lysophosphatidyl acyltransferase having at least 70% sequence identity, preferably at least 80% sequence identity, and more preferably at least 90% sequence identity to any of SEQ ID NO: 18-19, 86-89.

In an embodiment, the LPAT is active on lysophosphatidic acids with short or medium fatty acids at the sn-1 position. In an embodiment, the LPAT has preference for lysophosphatidic acids with short or medium fatty acids at the sn-1 position.

In some embodiments, the LPAT with activity on medium and/or short-chain fatty acyl-CoAs is localized to the endoplasmic reticulum, cytosol, or lipid body of the fungal cell. This is achieved through removal of localization signals to other subcellular compartments from the expressed LPAT, and/or addition of localization signals to the desired subcellular compartment to the amino acid sequence of the expressed LPAT.

A particular aspect relates to a fungal cell capable of producing triacylglycerols. The fungal cell is genetically modified for expression of a heterologous LPAT selected from the above mentioned groups of heterologous LPATs. In this particular aspect, the fungal cells is not genetically modified for overexpression of a triacylcelygerol lipase. In an embodiment, the fungal cell is capable of producing triacylgylcerols with short and/or medium-chain fatty acids.

In an embodiment, the fungal cell is genetically modified for expression of a heterologous DGAT that has activity on short and/or medium-chain fatty acyl-CoAs and is selected from the group consisting *Elaeis guineensis* DGAT1-2 isoform X1 (GenBank: XP_010925471.1), *Elaeis guineensis* DGAT1-2 isoform X2 (GenBank: XP_010925472.1), *Elaeis guineensis* DGAT1-2 isoform X3 (GenBank: XP_010925473.1), *Elaeis guineensis* DGAT1-2 isoform X4 (GenBank: XP_010925474.1), *Elaeis guineensis* LOC105052865 (GenBank: XP_010932136.1), *Elaeis guineensis* LOC105043901 (GenBank: XP_029120027.1), *Elaeis guineensis* LOC105040465 (GenBank: XP_029119023.1), *Elaeis guineensis* LOC105047643 (GenBank: XP_010924968.1), *Elaeis guineensis* LOC105040102 (GenBank: XP_010914783.1), *Elaeis guineensis* LOC105035148 (GenBank: XP_010908889.1), *Cuphea avigera* var. *pulcherrima* DGAT1 (SEQ ID NO: 95), *Elaeis guineensis* DGAT1-2 (SEQ ID NO: 96), *Bos taurus* DGAT1 (SEQ ID NO: 97), *Capra hircus* DGAT1 isoform X2 (SEQ ID NO: 98), *Cocos nucifera* DGAT1 (SEQ ID NO: 99), *Euonymus alatus* DAcT (SEQ ID NO: 100), other *Cocos nucifera* putative DGAT (SEQ ID NO: 101-104), and a heterologous DGAT having at least 70% sequence identity, preferably at least 80% sequence identity, and more preferably at least 90% sequence identity to any of the above listed heterologous DGATs.

In a preferred embodiment, the heterologous DGAT is selected from the group consisting of *Cuphea avigera* var. *pulcherrima* DGAT1 (SEQ ID NO: 95), *Elaeis guineensis* DGAT1-2 (SEQ ID NO: 96), *Bos taurus* DGAT1 (SEQ ID NO: 97), *Capra hircus* DGAT1 isoform X2 (SEQ ID NO: 98), *Cocos nucifera* DGAT1 (SEQ ID NO: 99), and a heterologous diacylglycerol acyltransferase having at least 70% sequence identity, preferably at least 80% sequence identity, and more preferably at least 90% sequence identity to any of SEQ ID NO: 95-99.

In an embodiment, the heterologous DGAT is active on diacylglycerol substrates with short or medium fatty acids at the sn-1 and/or sn-2 position. In an embodiment, the heterologous DGAT has preference for diacylglycerol substrates with short or medium fatty acids at the sn-1 and/or sn-2 position.

In some embodiments, the DGAT with activity on medium and/or short-chain fatty acyl-CoAs is localized to the endoplasmic reticulum, cytosol, or lipid body of the fungal cell. This is achieved through removal of localization signals to other subcellular compartments from the expressed DGAT, and/or addition of localization signals to the desired subcellular compartment to the amino acid sequence of the expressed DGAT.

A particular aspect relates to a fungal cell capable of producing triacylglycerols. The fungal cell is genetically modified for expression of a heterologous DGAT selected from the above mentioned groups of heterologous DGATs. In this particular aspect, the fungal cells is not genetically modified for overexpression of a triacylcelygerol lipase. In an embodiment, the fungal cell is capable of producing triacylgylcerols with short and/or medium-chain fatty acids.

In an embodiment, the presence of short and medium-chain fatty acids within triacylglycerol species is increased by overexpression of a triacylglycerol lipase having lower activity on medium and/or short-chain fatty acids in the triacylglycerol compared to long-chain fatty acids.

In an embodiment, the triacylglycerol lipase is selected from the group consisting of *Yarrowia lipolytica* Lip2 (SEQ ID NO: 12), *Yarrowia deformans* Lip1 (SEQ ID NO: 147), *Yarrowia phangngaensis* Lip2a (GenBank: CDX09915.1), *Yarrowia phangngaensis* Lip2d (GenBank: CDX09918.1), *Yarrowia phangngaensis* Lip2e (GenBank: CDX09919.1), *Yarrowia phangngaensis* Lip2b (GenBank: CDX09916.11), *Yarrowia lipolytica* Lip11 (GenBank: AFH77826.1), *Candida hispaniensis* LIP2b (GenBank: CDX09892.1), *Solanum lycopersicum* LeLID1 (SEQ ID NO: 50), *Capsicum baccatum* CQW23_29984 (GeneBank accession: PHT30390.1), *Capsicum annuum* T459_05088 (GeneBank accession: XP_016559794.1), *Mucuna pruriens* DSEL (GeneBank accession: RDX62039.1), *Triticum Urartu* TRIUR3_31903 (GeneBank accession: EMS63185.1), *Streptomyces coelicolor* Lipase 1 (SEQ ID NO: 43), *Streptomyces coelicolor* Lipase 2 (UniProtKB/Swiss-Prot: Q93J06, SV=1), *Amycolatopsis mediterranei* U32 lipase encoded by AMED_7492 (SEQ ID NO: 105), *Burkholderia cepacia* Alkaline lipase A9QXC9 (SEQ ID NO: 106), *Paraburkholderia kunuriensis* triacylglycerol lipase (GeneBank accession: WP_126875567.1), *Trinickia soli* triacylglycerol lipase (GeneBank accession: WP_102609174.1), *Psychrobacter* sp. 7195 lipA1 (SEQ ID NO: 107), *Psychrobacter* sp. C18 lipX (GeneBank accession: ADD74206.1), *Blastobottys adeninivorans* alip1 (SEQ ID NO: 108), *Geobacillus stearothermophilus* Q9L6D3

(SEQ ID NO: 109), *Geobacillus* sp. TFV-3 lipase (GenBank accession: WP_160157590.1), *Aneurinibacillus* sp. XH2 ACH33_16875 (GeneBank accession: WP_057900039.1), *Serratia marcescens* esf (SEQ ID NO: 110), *Photorhabdus laumondii* lipase (GeneBank accession: WP_113025139.1), *Geotrichum candidum* Q0MVP3 (SEQ ID NO: 111), *Geotrichum candidum* lipase (GeneBank accession: ACX69980.1), *Geotrichum fermentans* lipase (GeneBank accession: AIN94968.1), *Fusarium vanettenii* 77-13-4 gene encoded by NECHADRAFT_34836 (SEQ ID NO: 112), *Fusarium solani* lipase (GeneBank accession: AKN45016.1), *Neonectria ditissima* AK830_g7730 (GenBank accession: KPM38808.1), *Bacillus amyloliquefaciens* lip4 (SEQ ID NO: 113), *Bacillus nakamurai* AXI58_00300 (GenBank: WP_061520005.1), *Bacillus nakamurai* AXI58_00295 (GeneBank accession: WP_061520004.1), *Malassezia globosa* CBS 7966 LIP1 (SEQ ID NO: 114), *Serratia liquefaciens* lipase (SEQ ID NO: 115), *Geotrichum candidum* LIP1 (SEQ ID NO: 41), *Geotrichum candidum* lipase ((GeneBank accession: CAA54963.1), *Diutina rugosa* LIP1 (SEQ ID NO: 39), *Diutina rugosa* LIP2 (SEQ ID NO: 116), *Diutina rugosa* LIP3 (UniProtKB/Swiss-Prot: P32947, SV=1), and a triacylglycerol lipase having at least 70% sequence identity, preferably at least 80% sequence identity, and more preferably at least 90% sequence identity to any of the above listed triacylglycerol lipases.

In a preferred embodiment, the triacylglycerol lipase is selected from the group consisting of *Yarrowia deformans* Lip1 (SEQ ID NO: 147), *Amycolatopsis mediterranei* U32 lipase AMED_7492 (SEQ ID NO: 105), *Burkholderia cepacia* Alkaline lipase A9QXC9 (SEQ ID NO: 106), *Psychrobacter* sp. 7195 lipA1 (SEQ ID NO: 107), *Geobacillus stearothermophilus* Q9L6D3 (SEQ ID NO: 109), *Serratia marcescens* esf (SEQ ID NO: 110), *Geotrichum candidum* Q0MVP3 (SEQ ID NO: 111), *Fusarium vanettenii* 77-13-4 encoded by NECHADRAFT_34836 (SEQ ID NO: 112), *Bacillus amyloliquefaciens* lip4 (SEQ ID NO: 113), *Geotrichum candidum* LIP1 (SEQ ID NO: 41), *Diutina rugosa* LIP1 (SEQ ID NO: 39), *Diutina rugosa* LIP2 (SEQ ID NO: 116), and a triacylglycerol lipase having at least 70% sequence identity, preferably at least 80% sequence identity, and more preferably having at least 90% sequence identity to any of SEQ ID NO: 147, 105-107, 109-113, 41, 39, 116.

In some embodiments, the triacylglycerol lipase with lower activity on medium and/or short-chain fatty acids in the triacylglycerol compared to long-chain fatty acids is expressed without a secretion signal. Secretion signals within amino acid sequences can be detected using SignalP 5.0 (Almagro Armenteros et al, 2019), Signal-BLAST (Franks and Sippl, 2008), or PrediSi.

In an embodiment, the fungal cell is genetically modified for overexpression of a triacylglycerol lipase having lower activity on medium and/or short-chain fatty acids in the triacylglycerol compared to long-chain fatty acids, such as any of the triacylglycerol lipases mentioned above, and for expression of a heterologous GPAT with activity, preferably preference, for short and/or medium-chain fatty acyl-CoAs, such as any of the GPATs mentioned above.

In another embodiment, the fungal cell is genetically modified for overexpression of a triacylglycerol lipase having lower activity on medium and/or short-chain fatty acids in the triacylglycerol compared to long-chain fatty acids, such as any of the triacylglycerol lipases mentioned above, and for expression of a heterologous DGAT with activity, preferably preference, for short and/or medium-chain fatty acyl-CoAs, such as any of the DGATs mentioned above.

In a further embodiment, the fungal cell is genetically modified for overexpression of a triacylglycerol lipase having lower activity on medium and/or short-chain fatty acids in the triacylglycerol compared to long-chain fatty acids, such as any of the triacylglycerol lipases mentioned above, and for expression of a heterologous LPAT with activity, preferably preference, for short and/or medium-chain fatty acyl-CoAs, such as any of the LPATs mentioned above.

In yet another embodiment, the fungal cell is genetically modified for overexpression of a triacylglycerol lipase having lower activity on medium and/or short-chain fatty acids in the triacylglycerol compared to long-chain fatty acids, such as any of the triacylglycerol lipases mentioned above, for expression of a heterologous GPAT with activity, preferably preference, for short and/or medium-chain fatty acyl-CoAs, such as any of the GPAT mentioned above and for expression of a heterologous DGAT with activity, preferably preference, for short and/or medium-chain fatty acyl-CoAs, such as any of the DGAT mentioned above.

In an embodiment, the fungal cell is genetically modified for overexpression of a triacylglycerol lipase having lower activity on medium and/or short-chain fatty acids in the triacylglycerol compared to long-chain fatty acids, such as any of the triacylglycerol lipases mentioned above, for expression of a heterologous GPAT with activity, preferably preference, for short and/or medium-chain fatty acyl-CoAs, such as any of the GPAT mentioned above and for expression of a heterologous LPAT with activity, preferably preference, for short and/or medium-chain fatty acyl-CoAs, such as any of the LPAT mentioned above.

In another embodiment, the fungal cell is genetically modified for overexpression of a triacylglycerol lipase having lower activity on medium and/or short-chain fatty acids in the triacylglycerol compared to long-chain fatty acids, such as any of the triacylglycerol lipases mentioned above, for expression of a heterologous DGAT with activity, preferably preference, for short and/or medium-chain fatty acyl-CoAs, such as any of the DGAT mentioned above and for expression of a heterologous LPAT with activity, preferably preference, for short and/or medium-chain fatty acyl-CoAs, such as any of the LPAT mentioned above.

In a further embodiment, the fungal cell is genetically modified for overexpression of a triacylglycerol lipase having lower activity on medium and/or short-chain fatty acids in the triacylglycerol compared to long-chain fatty acids, such as any of the triacylglycerol lipases mentioned above, for expression of a heterologous GPAT with activity, preferably preference, for short and/or medium-chain fatty acyl-CoAs, such as any of the GPAT mentioned above, for expression of a heterologous DGAT with activity, preferably preference, for short and/or medium-chain fatty acyl-CoAs, such as any of the DGAT mentioned above and for expression of a heterologous LPAT with activity, preferably preference, for short and/or medium-chain fatty acyl-CoAs, such as any of the LPAT mentioned above.

In a preferred embodiment, the fungal cell is *Saccharomyces cerevisiae* or *Yarrowia lipolytica* and is genetically modified for:

expression of a heterologous GPAT selected from *Bos taurus* GPAT4 isoform X1 (SEQ ID NO: 52), *Bos taurus* GPAT4 isoform X2 (SEQ ID NO: 53), *Cocos nucifera* GPAT9 (SEQ ID NO: 80), *Bos taurus* GPAM (SEQ ID NO: 81), and a heterologous GPAT having at least 70% sequence identity, preferably at least 80% sequence identity, and more preferably at least 90% sequence identity to any of SEQ ID NO: 52-53, 80-81; and/or expression of a heterologous LPAT selected from *Bos taurus* AGPAT3 (SEQ ID NO: 18), *Bos taurus* AGPAT5 (SEQ ID NO: 19), *Cocos nucifera* probable LPAT (SEQ ID NO: 86), *Cuphea viscosissima* LPAT2 (SEQ ID NO: 87), *Cuphea avigera* var. *pulcherrima* LPAT2a (SEQ ID NO: 88), *Cuphea avigera* var. *pulcherrima* LPATB (SEQ ID NO: 89), and a heterologous GPAT having at least 70% sequence identity, preferably at least 80% sequence identity, and more preferably at least 90% sequence identity to any of SEQ ID NO: 18-19, 86-89; and/or expression of a heterologous DGAT selected from *Cuphea avigera* var. *pulcherrima* DGAT1 (SEQ ID NO: 95), *Elaeis guineensis* DGAT1-2 (SEQ ID NO: 96), *Bos taurus* DGAT1 (SEQ ID NO: 97), *Capra hircus* DGAT1 isoform X2 (SEQ ID NO: 98), *Cocos nucifera* DGAT1 (SEQ ID NO: 99), and a heterologous DGAT having at least 70% sequence identity, preferably at least 80% sequence identity, and more preferably at least 90% sequence identity to any of SEQ ID NO: 95-99.

In another particular embodiment, the fungal cell is *Saccharomyces cerevisiae* or *Yarrowia lipolytica* genetically modified for:

overexpression of a triacylglycerol lipase selected from the group consisting of *Yarrowia deformans* Lip1 (SEQ ID NO: 147), *Amycolatopsis mediterranei* U32 lipase AMED_7492 (SEQ ID NO: 105), *Burkholderia cepacia* Alkaline lipase A9QXC9 (SEQ ID NO: 106), *Psychrobacter* sp. 7195 lipA1 (SEQ ID NO: 107), *Geobacillus stearothermophilus* Q9L6D3 (SEQ ID NO: 109), *Serratia marcescens* esf (SEQ ID NO: 110), *Geotrichum candidum* Q0MVP3 (SEQ ID NO: 111), *Fusarium vanettenii* 77-13-4 encoded by NECHADRAFT_34836 (SEQ ID NO: 112), *Bacillus amyloliquefaciens* lip4 (SEQ ID NO: 113), *Geotrichum candidum* LIP1 (SEQ ID NO: 41), *Diutina rugosa* LIP1 (SEQ ID NO: 39), *Diutina rugosa* LIP2 (SEQ ID NO: 116), and a triacylglycerol lipase having at least 70% sequence identity, preferably at least 80% sequence identity, and more preferably having at least 90% sequence identity to any of SEQ ID NO: 147, 105-107, 109-113, 41, 39, 116; and expression of a heterologous GPAT, and/or DGAT, wherein:

the heterologous GPAT is selected from the group consisting of *Bos taurus* GPAT4 isoform X1 (SEQ ID NO: 52), *Bos taurus* GPAT4 isoform X2 (SEQ ID NO: 53), *Cocos nucifera* GPAT9 (SEQ ID NO: 80), *Bos taurus* GPAM (SEQ ID NO: 81), and a heterologous GPAR having at least 70% sequence identity, preferably at least 80% sequence identity, and more preferably having at least 90% sequence identity to any of SEQ ID NO: 52-53, 80-81; the heterologous LPAT is selected from the group consisting of *Bos taurus* AGPAT3 (SEQ ID NO: 18), *Bos taurus* AGPAT5 (SEQ ID NO: 19), *Cocos nucifera* probable LPAT (SEQ ID NO: 86), *Cuphea viscosissima* LPAT2 (SEQ ID NO: 87), *Cuphea avigera* var. *pulcherrima* LPAT2a (SEQ ID NO: 88), *Cuphea avigera* var. *pulcherrima* LPATB (SEQ ID NO: 89), and a heterologous GPAT having at least 70% sequence identity, preferably at least 80% sequence identity, and more preferably having at least 90% sequence identity to any of SEQ ID NO: 18-19, 86-87, 88-89;

the heterologous DGAT selected from the group consisting of *Cuphea avigera* var. *pulcherrima* DGAT1 (SEQ ID NO: 95), *Elaeis guineensis* DGAT1-2 (SEQ ID NO: 96), *Bos taurus* DGAT1 (SEQ ID NO: 97), *Capra hircus* DGAT1 isoform X2 (SEQ ID NO: 98), *Cocos nucifera* DGAT1 (SEQ ID NO: 99), and a heterologous DGAT having at least 70% sequence identity, preferably at least 80% sequence identity, and more preferably having at least 90% sequence identity to any of SEQ ID NO: 95-99.

In an embodiment, the presence of short and medium-chain fatty acids within triacylglycerol species is increased by increasing the supply of short and medium-chain fatty acyl-CoAs. This is achieved by overexpressing an acyl-CoA oxidase (EC 1.3.3.6), preferably an acyl-CoA oxidase having activity on fatty acyl-CoAs that are C6 or higher. In an embodiment, the acyl-CoA oxidase has higher acyl-CoA oxidase activity on fatty acids with a carbon chain of CX or greater compared to fatty acids with a carbon chain of C4 to C(X-2). X is selected from the group consisting of 6, 8, 10, 12, 14 and 16. In a particular embodiment, the acyl-CoA oxidase has higher activity on fatty acids with carbon chains of C16 or greater compared to on fatty acids with carbon chains of C4-C14. In another particular embodiment, the acyl-CoA oxidase has higher activity on fatty acids with carbon chains of C14 or greater compared to on fatty acids with carbon chains of C4-C12. In a further particular embodiment, the acyl-CoA oxidase has higher activity on fatty acids with carbon chains of C12 or greater compared to on fatty acids with carbon chains of C4-C10. In yet another particular embodiment, the acyl-CoA oxidase has higher activity on fatty acids with carbon chains of C10 or greater compared to on fatty acids with carbon chains of C4-C8. In another particular embodiment, the acyl-CoA oxidase has higher activity on fatty acids with carbon chains of C8 or greater compared to on fatty acids with carbon chains of C4-C6. In a further particular embodiment, the acyl-CoA oxidase has higher activity on fatty acids with carbon chains of C6 or greater compared to on fatty acids with carbon chains of C4. In an embodiment, multiple acyl-CoA oxidases with varying specificities are overexpressed in a single fungal cell to create the desired fatty acid spectrum. In a preferred embodiment, the acyl-CoA oxidase is a heterologous acyl-CoA oxidase.

In an embodiment, the acyl-CoA oxidase is selected from the group consisting of *Arabidopsis thaliana* ACX1 (SEQ ID NO: 117-118), *Eutrema salsugineum* ACX1.2 (GenBank: XP_006410738.1), *Sesamum indicum* ACX1 (GenBank: XP_011070219.1), *Arabidopsis thaliana* ACX2 (SEQ ID NO: 119-120), *Rosa chinensis* ACX2 (GenBank: XP_024180313.1), *Arabidopsis thaliana* ACX3 (SEQ ID NO: 121), *Yarrowia lipolytica* POX1 (UniProtKB/Swiss-Prot: 074934, SV=1), *Yarrowia lipolytica* POX2 (SEQ ID NO: 122), *Sugiyamaella lignohabitans* oxidase (GenBank: XP_018737261.1), *Yarrowia lipolytica* POX3 (SEQ ID NO: 123), *Yarrowia lipolytica* POX4 (GenBank: XP_504475.1), *Yarrowia lipolytica* POX5 (GenBank: XP_502199.1), *Yarrowia lipolytica* POX6 (GenBank: XP_503632.1), *Homo sapiens* ACOX1 isoform b (SEQ ID NO: 124), *Zonotrichia albicollis* ACOX1 isoform X2 (GenBank: XP_005494131.1), *Glycine max* ACX (SEQ ID NO: 125), *Theobroma cacao* ACX1 (GenBank: EOY24279.1), *Paenarthrobacter ureafaciens* aco (SEQ ID NO: 126), *Pseudarthrobacter sulfonivorans* AU252_21750 (GenBank: ALV43468.1), *Rattus norvegicus* ACOX1 (SEQ ID NO: 127), *Rattus rattus* ACOX1 isoform X2 (SEQ ID NO: 128), *Agrotis segetum* ACOX3 (GenBank: AID66678.1), *Agrotis*

*segetum* ACOX1 (GenBank: AID66679.1), *Heliothis virescens* B5V51_9816 (GenBank: PCG65014.1), *Chlamydomonas reinhardtii* CHLRE_05g232002v5 (SEQ ID NO: 129), *Coccomyxa subellipsoidea* C-169 oxidase (GenBank: XP_005646249.1), *Prunus persica* ACX1 (SEQ ID NO: 130), *Trema orientale* ACX (GenBank: PON97712.1), *Aspergillus nidulans* FGSC A4 AN6752.2 (GenBank: XP_664356.1), *Cucurbita maxima* LOC111482638 (GenBank: XP_022984291.1), *Ctenopseustis herana* ACOX1a (SEQ ID NO: 131), *Ctenopseustis herana* ACOX1b (SEQ ID NO: 132), *Ctenopseustis herana* ACOX1c (SEQ ID NO: 133), *Ctenopseustis herana* ACOX3a (SEQ ID NO: 134), *Ctenopseustis herana* ACOX3b (SEQ ID NO: 135), *Epiphyas postvittana* ACOX1b (SEQ ID NO: 136), *Epiphyas postvittana* ACOX1c (SEQ ID NO: 137), *Epiphyas postvittana* ACOX3a (SEQ ID NO: 138), *Epiphyas postvittana* ACOX3b (SEQ ID NO: 139), *Planotortrix excessana* ACOX1b (SEQ ID NO: 140), *Planotortrix excessana* ACOX1c (SEQ ID NO: 141), *Planotortrix excessana* ACOX3a (SEQ ID NO: 142), *Planotortrix excessana* ACOX3b (SEQ ID NO: 143), *Elaeis guineensis* ACX (UniProtKB/Swiss-Prot: A0A619S786, SV=1; or A0A619R5J7, SV=1), *Elaeis guineensis* ACX3 (UniProtKB/Swiss-Prot: A0A6I9QVJ8, SV=1), *Elaeis guineensis* ACX2 (UniProtKB/Swiss-Prot: A0A6I9R2R0, SV=1), *Elaeis guineensis* ACX1 (UniProtKB/Swiss-Prot: A0A619SK48, SV=1), *Elaeis guineensis* ACX1.2 (UniProtKB/Swiss-Prot: A0A619S7D9, SV=1), *Cocos nucifera* putative ACX (SEQ ID NO: 144-145), *Galleria mellonella* ACOX1 (GenBank: XP_026759288.1, XP_026759158.1, XP_026759161.1, XP_026758799.1, XP_026758707.1, XP_026758677.1 XP_026758676.1, or XP_026759159.1), *Galleria mellonella* ACOX3 (GenBank: XP_026757688.1 or XP_026757774.1), *Ostrinia furnacalis* ACOX1 (GenBank: XP_028165831.1, XP_028156318.1, XP_028156325.1, XP_028165894.1, XP_028156323.1, or XP_028156317.1), *Ostrinia furnacalis* ACOX3 (XP_028168002.1, XP_028168001.1, XP_028168000.1, or XP_028162586.1), *Spodoptera frugiperda* ACOX1 (XP_035442468.1, XP_035449260.1, XP_035442418.1, XP_035442368.1, XP_035442324.1, XP_035442351.1, or XP_035442457.1), *Spodoptera frugiperda* ACOX3 (GenBank: XP_035436449.1, or XP_035436587.1), *Spodoptera litura* ACOX1 (GenBank: XP_022821900.1, XP_022821901.1, XP_022821502.1, XP_022821682.1, XP_022821685.1, XP_022821686.1, XP_022821688.1, or XP_022821956.1), *Spodoptera litura* ACOX3 (GenBank: XP_022819818.1), *Trichoplusia ni* ACOX1 (XP_026731722.1, XP_026731714.1, XP_026731467.1, XP_026731715.1, XP_026731719.1, or XP_026731720.1), *Trichoplusia ni* ACOX3 (XP_026747712.1 or XP_026747760.1), *Papilio machaon* ACOX1 (GenBank: KPJ09429.1, XP_014366075.1, XP_014365981.1, XP_014365980.1, KPJ09436.1, KPJ09432.1, or KPJ09433.1), *Papilio* ACOX3 (XP_014370828.1, KPJ19117.1, XP_014370825.1, or KPJ19096.1), *Bicyclus anynana* ACOX1 (GenBank: XP_023945579.1, XP_023945597.1, XP_023945588.1, or XP_023945587.1), *Bicyclus anynana* ACOX3 (GenBank: XP_023935546.1 or XP_023945416.1), and an acyl-CoA oxidase having at least 70% sequence identity, preferably at least 80% sequence identity, and more preferably having at least 90% sequence identity to any of the above listed acyl-CoA oxidases.

In a preferred embodiment, the acyl-CoA oxidase is selected from the group consisting of *Arabidopsis thaliana* ACX1 (SEQ ID NO: 117-118), *Arabidopsis thaliana* ACX2 (SEQ ID NO: 119-120), *Arabidopsis thaliana* ACX3 (SEQ ID NO: 121), *Yarrowia lipolytica* POX2 (SEQ ID NO: 122), *Yarrowia lipolytica* POX3 (SEQ ID NO: 123), *Glycine max* ACX (SEQ ID NO: 125), *Paenarthrobacter ureafaciens* aco (SEQ ID NO: 126), *Rattus norvegicus* ACOX1 (SEQ ID NO: 127), *Rattus rattus* ACOX1 isoform X2 (SEQ ID NO: 128), *Chlamydomonas reinhardtii* CHLRE_05g232002v5 (SEQ ID NO: 129), *Prunus persica* ACX1 (SEQ ID NO: 130), *Cocos nucifera* putative ACX (SEQ ID NO: 144-145), and an acyl-CoA oxidase having at least 70% sequence identity, preferably at least 80% sequence identity, and more preferably at least 90% sequence identity to any of SEQ ID NO: 117-123, 125-130, 144-145.

In an embodiment, multiple heterologous acyl-CoA oxidases can be expressed in a single fungal cell.

Another aspect of the invention relates to a fungal cell genetically modified for expression, such as overexpression, of an acyl-CoA oxidase. In a preferred embodiment, the acyl-CoA oxidase has higher acyl-CoA oxidase activity on fatty acids with a carbon chain of C16 or greater compared to fatty acids with a carbon chain of C4 to C14. In an embodiment, the acyl-CoA oxidase is selected among the above listed acyl-CoA oxidases.

In the above described aspect and embodiments thereof, the fungal cell is genetically modified for overexpression of a triacylglycerol lipase and for expression of at least one heterologous enzyme selected from the group consisting of GPAT, LPAT and DGAT. Another aspect of the invention relates to a fungal cell capable of producing triacylglycerols with fatty acids with an acyl chain having a target characteristic. The fungal cell is genetically modified for overexpression of a triacylglycerol lipase having preference for hydrolysis, from triacylglycerols, of fatty acids with an acyl chain not having the target characteristic over hydrolysis, from triacylglycerols, of fatty acids with an acyl chain having the target characteristic.

In an embodiment, the triacylglycerol lipase has lower lipase activity on very long-chain fatty acids of triacylglycerols, in particular at the sn-113 position, compared to long-chain fatty acids. In a particular embodiment, the triacylglycerol lipase is selected among the above described examples of triacylglycerol lipases having lower lipase activity on very long-chain fatty acids of triacylglycerols compared to long-chain fatty acids.

In another embodiment, the triacylglycerol lipase has higher lipase activity on unsaturated fatty acids of triacylglycerols compared to saturated fatty acids. In a particular embodiment, the triacylglycerol lipase is selected among the above described examples of triacylglycerol lipases having higher lipase activity on unsaturated fatty acids of triacylglycerols compared to saturated fatty acids.

In a further embodiment, the triacylglycerol lipase has lower lipase activity on short and/or medium-chain fatty acids of glycerols compared to long-chain fatty acids. In a particular embodiment, the triacylglycerol lipase is selected among the above described examples of triacylglycerol lipases having lower lipase activity on short and/or medium-chain fatty acids of glycerols compared to long-chain fatty acids.

In an embodiment, the lipase selected from of any of the lipases described above is expressed without a secretion signal. Secretion signals within amino acid sequences can be detected using SignalP 5.0 (Almagro Armenteros et al, 2019), Signal-BLAST (Franks and Sippl, 2008), or PrediSi.

A further aspect of the invention relates to a fungal cell capable of producing triacylglycerols with fatty acids with an acyl chain having a target characteristic. The fungal cell is genetically modified for expression of at least one heter-ologous enzyme capable of esterifying a triacylglycerol precursor with an acyl-CoA with an acyl chain having the target characteristic. The at least one heterologous enzyme is selected from the group consisting of GPAT, LPAT and DGAT.

In an embodiment, the at least one heterologous enzyme has preference for esterifying a triacylglycerol precursor with an acyl-CoA with an acyl chain having the target characteristic compared to esterifying the triacylglycerol precursor with an acyl-CoA with an acyl chain not having the target characteristic.

In an embodiment, the at least one heterologous enzyme is capable of esterifying the triacylglycerol precursor with a very long-chain acyl-CoA and preferably has preference for esterifying the triacylglycerol precursor with a very long-chain acyl-CoA over esterifying the triacylglycerol precursor with a long-chain acyl-CoA.

In an embodiment, the fungal cell is genetically modified for expression of a heterologous GPAT capable of, prefer-ably having preference for, esterifying glycerol-3-phosphate with a very long-chain acyl-CoA. In a particular embodiment, the heterologous GPAT is selected among the above described examples of heterologous GPATs capable of, preferably having preference for, esterifying glycerol-3-phosphate with a very long-chain acyl-CoA. In another embodiment, the fungal cell is genetically modified for expression of a heterologous DGAT capable of, preferably having preference for, esterifying DAG with a very long-chain acyl-CoA. In a particular embodiment, the heterolo-gous DGAT is selected among the above described examples of heterologous DGATs capable of, preferably having pref-erence for, esterifying DAG with a very long-chain acyl-CoA. In a further embodiment, the fungal cell is genetically modified for expression of a heterologous GPAT and a heterologous DGAT capable of, preferably having prefer-ence for, esterifying triacylglycerol precursors with a very long-chain acyl-CoA. In a particular embodiment, the het-erologous GPAT and DGAT are selected among the above described examples of heterologous GPATs and DGATs capable of, preferably having preference for, esterifying the triacylglycerol precursors with a very long-chain acyl-CoA.

In another embodiment, the at least one heterologous enzyme is capable of esterifying the triacylglycerol precur-sor with a saturated fatty acyl-CoA and preferably has preference for esterifying the triacylglycerol precursor with a saturated fatty acyl-CoA over esterifying the triacylglyc-erol precursor with an unsaturated fatty acyl-CoA.

In an embodiment, the fungal cell is genetically modified for expression of a heterologous GPAT capable of, prefer-ably having preference for, esterifying glycerol-3-phosphate with a saturated fatty acyl-CoA. In a particular embodiment, the heterologous GPAT is selected among the above described examples of heterologous GPATs capable of, preferably having preference for, esterifying glycerol-3-phosphate with a saturated fatty acyl-CoA. In another embodiment, the fungal cell is genetically modified for expression of a heterologous LPAT capable of, preferably having preference for, esterifying LPA with a saturated fatty acyl-CoA. In a particular embodiment, the heterologous LPAT is selected among the above described examples of heterologous LPATs capable of, preferably having prefer-ence for, esterifying LPA with a saturated fatty acyl-CoA. In a further embodiment, the fungal cell is genetically modified for expression of a heterologous DGAT capable of, prefer-ably having preference for, esterifying DAG with a saturated fatty acyl-CoA. In a particular embodiment, the heterolo-gous DGAT is selected among the above described examples of heterologous DGATs capable of, preferably having preference for, esterifying DAG with a saturated fatty acyl-CoA. In yet other embodiments, the fungal cell is genetically modified for expression of a heterologous GPAT capable of, preferably having preference for, esterifying glycerol-3-phosphate with a saturated fatty acyl-CoA and a heterologous LPAT capable of, preferably having preference for, esterifying LPA with a saturated fatty acyl-CoA; a heterologous GPAT capable of, preferably having preference for, esterifying glycerol-3-phosphate with a saturated fatty acyl-CoA and a heterologous DGAT capable of, preferably having preference for, esterifying DAG with a saturated fatty acyl-CoA; a heterologous LPAT capable of, preferably having preference for, esterifying LPA with a saturated fatty acyl-CoA and a heterologous DGAT capable of, preferably having preference for, esterifying DAG with a saturated fatty acyl-CoA; or a heterologous GPAT capable of, preferably having preference for, esterifying glycerol-3-phosphate with a saturated fatty acyl-CoA, a heterologous LPAT capable of, preferably having preference for, esterifying LPA with a saturated fatty acyl-CoA and a heterologous DGAT capable of, preferably having preference for, esterifying DAG with a saturated fatty acyl-CoA. In these other embodiments, the heterologous GPAT, LPAT and/or DGAT are preferably selected among the above described examples of heterologous GPATs, LPATs and DGATs capable of, preferably having preference for, esterifying the triacylglycerol precursors with a saturated fatty acyl-CoA.

An aspect relates to a fungal cell capable of producing triacylglycerols with fatty acids with an acyl chain having a target characteristic. The fungal cell is genetically modified for expression of a heterologous LPAT capable of esterifying a triacylglycerol precursor with an acyl-CoA with an acyl chain having the target characteristic. The heterologous LPAT has preference for esterifying a triacylglycerol precursor with a saturated fatty acyl-CoA over esterifying a triacylglycerol precursor with an unsaturated fatty acyl-CoA.

In this aspect, the expression of the at least one heterologous LPAT increases the saturation level of triacylglycerols or lipids in the fungal cell, i.e., increases the % saturation of triacylglycerols or lipids in the fungal cell.

In an embodiment, the fungal cells is genetically modified for overexpression of a triacylglycerol lipase and the triacylglycerol lipase has higher lipase activity on unsaturated fatty acids of triacylglycerols compared to saturated fatty acids.

In a particular embodiment, the triacylglycerol lipase is selected from the group consisting of Homo sapiens PNLIP as defined in SEQ ID NO: 11, Yarrowia lipolytica Lip2 as defined in SEQ ID NO: 12, Diutina rugosa LIP1 as defined in SEQ ID NO: 39, Streptomyces rimosus CP984_RS32550 as defined in SEQ ID NO: 40, Geotrichum candidum LIP1 as defined in SEQ ID NO: 41, Geotrichum candidum LIP2 as defined in SEQ ID NO: 42, Streptomyces coelicolor LIP1 as defined in SEQ ID NO: 43, Amycolatopsis mediterranei AMED_3680 as defined in SEQ ID NO: 45, Penaeus vannamei C7M84_014708 as defined in SEQ ID NO: 48, Solanum lycopersicum LeLID1 as defined in SEQ ID NO: 50, Pseudozyma aphidis LIPA as defined in SEQ ID NO: 51, and a triacylglycerol lipase having at least 70% sequence identity, preferably at least 80% sequence identity, and more preferably at least 90% sequence identity to any of SEQ ID NO: 11-12, 39-43, 45, 48, 50-51.

In an embodiment, the fungal cell is genetically modified for expression of a heterologous GPAT.

In a particular embodiment, the GPAT is selected from the group consisting of Bos taurus GPAT4 isoform X1 as defined in SEQ ID NO: 52, Bos taurus GPAT4 isoform X2 as defined in SEQ ID NO: 53, Bos taurus GPAT2 as defined in SEQ ID NO: 54, Bos taurus GPAT3 isoform X1 as defined in SEQ ID NO: 55, Bos taurus GPAT3 isoform X2 as defined in SEQ ID NO: 56, Bos taurus GPAT3 isoform X3 as defined in SEQ ID NO: 57, Bos taurus GPAT3 isoform X4 as defined in SEQ ID NO: 58, Mus musculus GPAT4 isoform X1 as defined in SEQ ID NO: 59, Homo sapiens GPAM isoform X1 as defined in SEQ ID NO: 60, Cucurbita moschata ATS1;2 as defined in SEQ ID NO: 61, Mus musculus GPAT2 as defined in SEQ ID NO: 63, and a heterologous GPAT having at least 70% sequence identity, preferably at least 80% sequence identity, and more preferably at least 90% sequence identity to any of SEQ ID NO: 52-61, 63.

In an embodiment, the heterologous LPAT is selected from the group consisting of Bos taurus AGPAT4 as defined in SEQ ID NO: 13, 14, or 15, Bos taurus AGPAT1 as defined in SEQ ID NO: 16, Bos taurus AGPAT2 as defined in SEQ ID NO: 17, Bos taurus AGPAT3 as defined in SEQ ID NO: 18, Bos taurus AGPAT5 as defined in SEQ ID NO: 19, Arabidopsis thaliana LPAT1 as defined in SEQ ID NO: 20, Brassica napus LPAT1 as defined in SEQ ID NO: 24, Mycolicibacterium smegmatis ERS451418_00313 as defined in SEQ ID NO: 28, Mycolicibacterium smegmatis Probable LPAT as defined in SEQ ID NO: 29, Mycolicibacterium smegmatis ERS451418_06226 as defined in SEQ ID NO: 30, Mycolicibacterium smegmatis ERS451418_02370 as defined in SEQ ID NO: 31, Mycolicibacterium smegmatis ERS451418_05575 as defined in SEQ ID NO: 32, Mycolicibacterium smegmatis ERS451418_04128 as defined in SEQ ID NO: 33, Mycolicibacterium smegmatis ERS451418_06227 as defined in SEQ ID NO: 34, Mycolicibacterium smegmatis BIN_B_00519 as defined in SEQ ID NO: 35, Mycolicibacterium smegmatis D806_035910 as defined in SEQ ID NO: 36, Mycolicibacterium smegmatis BIN_B_03706 as defined in SEQ ID NO: 37, Mycolicibacterium smegmatis D806_003290 as defined in SEQ ID NO: 38, Cocos nucifera probable LPAT as defined in SEQ ID NO: 86, and a heterologous LPAT having at least 70% sequence identity, preferably at least 80% sequence identity, and more preferably at least 90% sequence identity to any of SEQ ID NO: 13-20, 24, 28-38, 86, preferably selected from the group consisting of Bos taurus AGPAT1 as defined in SEQ ID NO: 16, and a heterologous LPAT having at least 70% sequence identity, preferably at least 80% sequence identity, and more preferably at least 90% sequence identity to SEQ ID NO: 16.

In an embodiment, the fungal cell is genetically modified for expression of a heterologous DGAT.

In a particular embodiment, the DGAT selected from the group consisting of Brassica napus DGAT1-1 as defined in SEQ ID NO: 7, Tropaeolum majus DGAT as defined in SEQ ID NO: 10, Bos taurus DGAT1 isoform X1 as defined in SEQ ID NO: 64, Bos taurus DGAT1 isoform X2 as defined in SEQ ID NO: 65, Bos taurus DGAT2 as defined in SEQ ID NO: 66, Bos taurus DGAT2L6 as defined in SEQ ID NO: 67, Homo sapiens DGAT2 as defined in SEQ ID NO: 69, Arachis hypogaea DGAT3 as defined in SEQ ID NO: 70, Arabidopsis thaliana DGAT1 as defined in SEQ ID NO: 71, Thraustochytrium aureum DGAT2 as defined in SEQ ID NO: 72, and a heterologous DGAT having at least 70% sequence identity, preferably at least 80% sequence identity, and more preferably at least 90% sequence identity to any of SEQ ID NO: 7, 10, 64-67, 69-72, and more preferably a DGAT selected from the group consisting of Tropaeolum

*majus* DGAT as defined in SEQ ID NO: 10, *Arabidopsis thaliana* DGAT1 as defined in SEQ ID NO: 71, and a heterologous DGAT having at least 70% sequence identity, preferably at least 80% sequence identity, and more preferably at least 90% sequence identity to any of SEQ ID NO: 10, 71.

In an embodiment, the fungal cell is capable of producing lipids that are at least 30%, preferably at least 40%, and more preferably at least 50% saturated. In an embodiment, the fungal cell is capable of producing triacylglycerols that are at least 30%, preferably at least 40%, and more preferably at least 50% saturated.

In an embodiment, the fungal cell is capable of producing lipids that comprises at least 10%, at least 15%, at least 20%, at least 25%, at least 30%, at least 35%, at least 40%, at least 45%, at least 50%, at least 55% or at least 60% palmitic acid per total lipids.

In an embodiment, the fungal cell with any of the modifications above is producing triacylglycerols that comprise 25-50% oleic acid, 15-25% stearic acid, 20-30% palmitic acid, and 0-15% palmitoleic acid per total triacylglycerols.

In an embodiment, the fungal cell is capable of producing lipids that comprise at least 10%, at least 15%, at least 20%, at least 25%, at least 30%, at least 35%, at least 40%, at least 45%, at least 50% or at least 60% stearic acid per total lipids.

In an embodiment, the fungal cell is capable of producing triacylglycerols that comprise at least 10%, at least 15%, at least 20%, at least 25%, at least 30%, at least 35%, at least 40%, at least 45%, at least 50% or at least 60% stearic acid per total triacylglycerols. In an embodiment, the fungal cell is capable of producing lipids that comprise 25-50% oleic acid, 15-25% stearic acid, 20-30% palmitic acid, and 0-15% palmitoleic acid per total lipids.

In an embodiment, the fungal cell is capable of producing triacylglycerols that comprise at least 10%, at least 15%, at least 20%, at least 25%, at least 30%, at least 35%, at least 40%, at least 45%, at least 50%, at least 55% or at least 60% palmitic acid per total triacylglycerols.

In a further embodiment, the at least one heterologous enzyme is capable of esterifying the triacylglycerol precursor with a short or medium chain fatty acyl-CoA and preferably has preference for esterifying the triacylglycerol precursor with a short or medium chain fatty acyl-CoA over esterifying the triacylglycerol precursor with a long-chain fatty acyl-CoA.

In an embodiment, the fungal cell is genetically modified for expression of a heterologous GPAT capable of, preferably having preference for, esterifying glycerol-3-phosphate with a short or medium chain fatty acyl-CoA. In a particular embodiment, the heterologous GPAT is selected among the above described examples of heterologous GPATs capable of, preferably having preference for, esterifying glycerol-3-phosphate with a short or medium chain fatty acyl-CoA. In another embodiment, the fungal cell is genetically modified for expression of a heterologous LPAT capable of, preferably having preference for, esterifying LPA with a short or medium chain fatty acyl-CoA. In a particular embodiment, the heterologous LPAT is selected among the above described examples of heterologous LPATs capable of, preferably having preference for, esterifying LPA with a short or medium chain fatty acyl-CoA. In a further embodiment, the fungal cell is genetically modified for expression of a heterologous DGAT capable of, preferably having preference for, esterifying DAG with a short or medium chain fatty acyl-CoA. In a particular embodiment, the heterologous DGAT is selected among the above described examples of heterologous DGATs capable of, preferably having preference for, esterifying DAG with a short or medium chain fatty acyl-CoA. In yet other embodiments, the fungal cell is genetically modified for expression of a heterologous GPAT capable of, preferably having preference for, esterifying glycerol-3-phosphate with a short or medium chain fatty acyl-CoA and a heterologous LPAT capable of, preferably having preference for, esterifying LPA with a short or medium chain fatty acyl-CoA; a heterologous GPAT capable of, preferably having preference for, esterifying glycerol-3-phosphate with a short or medium chain fatty acyl-CoA and a heterologous DGAT capable of, preferably having preference for, esterifying DAG with a short or medium chain fatty acyl-CoA; a heterologous LPAT capable of, preferably having preference for, esterifying LPA with a short or medium chain fatty acyl-CoA and a heterologous DGAT capable of, preferably having preference for, DAG with a short or medium chain fatty acyl-CoA; or a heterologous GPAT capable of, preferably having preference for, esterifying glycerol-3-phosphate with a short or medium chain fatty acyl-CoA, a heterologous LPAT capable of, preferably having preference for, esterifying LPA with a short or medium chain fatty acyl-CoA and a heterologous DGAT capable of, preferably having preference for, esterifying DAG with a short or medium chain fatty acyl-CoA. In these other embodiments, the heterologous GPAT, LPAT and/or DGAT are preferably selected among the above described examples of heterologous GPATs, LPATs and DGATs capable of, preferably having preference for, esterifying the triacylglycerol precursors with a short or medium chain fatty acyl-CoA.

In an embodiment, the GPAT, LPAT or DGAT selected from any of the GPATs, LPATs, or DGATs described above is localized to the endoplasmic reticulum, cytosol, or lipid body of the fungal cell. This is achieved through removal of localization signals to other subcellular compartments from the expressed GPAT, LPAT or DGAT, and/or addition of localization signals to the desired subcellular compartment to the amino acid sequence of the expressed GPAT, LPAT or DGAT.

In a preferred embodiment, the fungal cell is *Saccharomyces cerevisiae* or *Yarrowia lipolytica* genetically modified for overexpression of an acyl-CoA oxidase selected from *Arabidopsis thaliana* ACX1 (SEQ ID NO: 117-118), *Arabidopsis thaliana* ACX2 (SEQ ID NO: 119-120), *Arabidopsis thaliana* ACX3 (SEQ ID NO: 121), *Yarrowia lipolytica* POX2 (SEQ ID NO: 122), *Yarrowia lipolytica* POX3 (SEQ ID NO: 123), *Glycine max* ACX (SEQ ID NO: 125), *Paenarthrobacter ureafaciens* aco (SEQ ID NO: 126), *Rattus norvegicus* ACOX1 (SEQ ID NO: 127), *Rattus rattus* ACOX1 isoform X2 (SEQ ID NO: 128), *Chlamydomonas reinhardtii* CHLRE_05g232002v5 (SEQ ID NO: 129), *Prunus persica* ACX1 (SEQ ID NO: 130), *Cocos nucifera* putative ACX (SEQ ID NO: 144-145), and an acyl-CoA oxidase having at least 70% sequence identity, preferably at least 80% sequence identity, and more preferably at least 90% sequence identity to any of SEQ ID NO: 117-123, 125-130, 144-145.

In another preferred embodiment, the fungal cell is *Saccharomyces cerevisiae* or *Yarrowia lipolytica* genetically modified for:

overexpression of an acyl-CoA oxidase selected from *Arabidopsis thaliana* ACX1 (SEQ ID NO: 117-118), *Arabidopsis thaliana* ACX2 (SEQ ID NO: 119-120), *Arabidopsis thaliana* ACX3 (SEQ ID NO: 121), *Yarrowia lipolytica* POX2 (SEQ ID NO: 122), *Yarrowia lipolytica* POX3 (SEQ ID NO: 123), *Glycine max* ACX (SEQ ID NO: 125), *Paenarthrobacter ureafaciens* aco (SEQ ID NO: 126), *Rattus novegicus* ACOX1 (SEQ ID NO: 127), *Rattus rattus* ACOX1 isoform X2 (SEQ ID NO: 128), *Chlamydomonas reinhardtii* CHLRE_05g232002v5 (SEQ ID NO: 129), *Prunus persica* ACX1 (SEQ ID NO: 130), *Cocos nucifera* putative ACX (SEQ ID NO: 144-145), and an acyl-CoA oxidase having at least 70% sequence identity, preferably at least 80% sequence identity, and more preferably at least 90% sequence identity to any of; and expression of a heterologous GPAT, LPAT, DGAT, and/or triacylglycerol lipase wherein:

the heterologous GPAT is selected from *Bos taurus* GPAT4 isoform X1 (SEQ ID NO: 52), *Bos taurus* GPAT4 isoform X2 (SEQ ID NO: 53), *Cocos nucifera* GPAT9 (SEQ ID NO: 80), *Bos taurus* GPAM (SEQ ID NO: 81), and a heterologous GPAT having at least 70% sequence identity, preferably at least 80% sequence identity, and more preferably at least 90% sequence identity to any of SEQ ID NO: 52-53, 80-81;

the heterologous LPAT is selected from *Bos taurus* AGPAT3 (SEQ ID NO: 18), *Bos taurus* AGPAT5 (SEQ ID NO: 19), *Cocos nucifera* probable LPAT (SEQ ID NO: 86), *Cuphea viscosissima* LPAT2 (SEQ ID NO: 87), *Cuphea avigera* var. *pulcherrima* LPAT2a (SEQ ID NO: 88), *Cuphea avigera* var. *pulcherrima* LPATB (SEQ ID NO: 89), and a heterologous LPAT having at least 70% sequence identity, preferably at least 80% sequence identity, and more preferably at least 90% sequence identity to any of SEQ ID NO: 18-19, 86-89;

the heterologous DGAT selected from *Cuphea avigera* var. *pulcherrima* DGAT1 (SEQ ID NO: 95), *Elaeis guineensis* DGAT1-2 (SEQ ID NO: 96), *Bos taurus* DGAT1 (SEQ ID NO: 97), *Capra hircus* DGAT1 isoform X2 (SEQ ID NO: 98), *Cocos nucifera* DGAT1 (SEQ ID NO: 99), and a heterologous DGAT having at least 70% sequence identity, preferably at least 80% sequence identity, and more preferably at least 90% sequence identity to any of SEQ ID NO: 95-99;

the triacylglycerol lipase is selected from *Yarrowia deformans* Lip1 (SEQ ID NO: 147), *Amycolatopsis mediterranei* U32 lipase AMED_7492 (SEQ ID NO: 105), *Burkholderia cepacia* Alkaline lipase A9QXC9 (SEQ ID NO: 106), *Psychrobacter* sp. 7195 lipA1 (SEQ ID NO: 107), *Geobacillus stearothermophilus* Q9L6D3 (SEQ ID NO: 109), *Serratia marcescens* esf (SEQ ID NO: 110), *Geotrichum candidum* Q0MVP3 (SEQ ID NO: 111), *Fusarium vanettenii* 77-13-4 gene encoded by NECHADRAFT_34836 (SEQ ID NO: 112), *Bacillus amyloliquefaciens* lip4 (SEQ ID NO: 113), *Geotrichum candidum* LIP1 (SEQ ID NO: 41), *Diutina rugosa* LIP1 (SEQ ID NO: 39), *Diutina rugosa* LIP2 (SEQ ID NO: 116), and a triacylglycerol lipase having at least 70% sequence identity, preferably at least 80% sequence identity, and more preferably at least 90% sequence identity to any of SEQ ID NO: 147, 105-107, 109-113, 41, 39, 116.

In an embodiment, the fungal cell is genetically modified for downregulation or deletion of an endogenous acyl-CoA oxidase. In a preferred embodiment, the fungal cell expressing a heterologous acyl-CoA oxidase, such as any of the acyl-CoA oxidases mentioned above, is genetically modified for deletion or downregulation of at least one endogenous acyl-CoA oxidase. In a preferred embodiment, the fungal cell is *Saccharomyces cerevisiae* and the downregulated or deleted endogenous acyl-CoA oxidase is POX1 (GenBank: NP_011310.1).

In a preferred embodiment, the fungal cell is *Saccharomyces cerevisiae* or *Yarrowia lipolytica* genetically modified for:

deletion, disruption, or downregulation of POX1; and expression of an acyl-CoA oxidase selected from the group consisting of *Arabidopsis thaliana* ACX1 (SEQ ID NO: 117-118), *Arabidopsis thaliana* ACX2 (SEQ ID NO: 119-120), *Arabidopsis thaliana* ACX3 (SEQ ID NO: 121), *Yarrowia lipolytica* POX2 (SEQ ID NO: 122), *Yarrowia lipolytica* POX3 (SEQ ID NO: 123), *Glycine max* ACX (SEQ ID NO: 125), *Paenarthrobacter ureafaciens* aco (SEQ ID NO: 126), *Rattus norvegicus* ACOX1 (SEQ ID NO: 127), *Rattus rattus* ACOX1 isoform X2 (SEQ ID NO: 128), *Chlamydomonas reinhardtii* CHLRE_05g232002v5 (SEQ ID NO: 129), *Prunus persica* ACX1 (SEQ ID NO: 130), *Cocos nucifera* putative ACX (SEQ ID NO: 144-145), and an acyl-CoA oxidase having at least 70% sequence identity, preferably at least 80% sequence identity, and more preferably at least 90% sequence identity to any of SEQ ID NO: 117-123, 125-130, 144-145; and expression of a heterologous GPAT, LPAT, DGAT, and/or triacylglycerol lipase wherein:

the heterologous GPAT is selected from *Bos taurus* GPAT4 isoform X1 (SEQ ID NO: 52), *Bos taurus* GPAT4 isoform X2 (SEQ ID NO: 53), *Cocos nucifera* GPAT9 (SEQ ID NO: 80), *Bos taurus* GPAM (SEQ ID NO: 81), and a heterologous GPAT having at least 70% sequence identity, preferably at least 80% sequence identity, and more preferably at least 90% sequence identity to any of SEQ ID NO: 52-53, 80-81;

the heterologous LPAT is selected from *Bos taurus* AGPAT3 (SEQ ID NO: 18), *Bos taurus* AGPAT5 (SEQ ID NO: 19), *Cocos nucifera* probable LPAT (SEQ ID NO: 86), *Cuphea viscosissima* LPAT2 (SEQ ID NO: 87), *Cuphea avigera* var. *pulcherrima* LPAT2a (SEQ ID NO: 88), *Cuphea avigera* var. *pulcherrima* LPATB (SEQ ID NO: 89), and a heterologous LPAT having at least 70% sequence identity, preferably at least 80% sequence identity, and more preferably at least 90% sequence identity to any of SEQ ID NO: 18-19, 86-89;

the heterologous DGAT selected from *Cuphea avigera* var. *pulcherrima* DGAT1 (SEQ ID NO: 95), *Elaeis guineensis* DGAT1-2 (SEQ ID NO: 96), *Bos taurus* DGAT1 (SEQ ID NO: 97), *Capra hircus* DGAT1 isoform X2 (SEQ ID NO: 98), *Cocos nucifera* DGAT1 (SEQ ID NO: 99), and a heterologous DGAT having at least 70% sequence identity, preferably at least 80% sequence identity, and more preferably at least 90% sequence identity to any of SEQ ID NO: 95-99;

the triacylglycerol lipase is selected from *Yarrowia deformans* Lip1 (SEQ ID NO: 147), *Amycolatopsis mediterranei* U32 lipase AMED_7492 (SEQ ID NO: 105), *Burkholderia cepacia* Alkaline lipase A9QXC9 (SEQ ID NO: 106), *Psychrobacter* sp. 7195 lipA1 (SEQ ID NO: 107), *Geobacillus stearothermophilus* Q9L6D3 (SEQ ID NO: 109), *Serratia marcescens* esf (SEQ ID NO: 110), *Geotrichum candidum* Q0MVP3 (SEQ ID NO: 111), *Fusarium vanettenii* 77-13-4 gene encoded by NECHADRAFT_34836 (SEQ ID NO: 112), *Bacillus amyloliq-*

*uefaciens* lip4 (SEQ ID NO: 113), *Geotrichum can-didum* LIP1 (SEQ ID NO: 41), *Diutina rugosa* LIP1 (SEQ ID NO: 39), *Diutina rugosa* LIP2 (SEQ ID NO: 116), and a triacylglycerol lipase having at least 70% sequence identity, preferably at least 80% sequence identity, and more preferably at least 90% sequence identity to any of SEQ ID NO: 147, 105-107, 109-113, 41, 39, 116.

In an embodiment, any of the proteins described above are localized into desired subcellular compartments of the fungal cell. This is achieved by removing localization signals to undesired subcellular compartments from the amino acid sequence of the protein expressed, and/or adding localization signals to desired compartments to the amino acid sequence of the protein expressed. In some cases, localization signals present in heterologous proteins are exchanged for localization signals suitable to use in the fungal cell.

In a preferred embodiment, any of the above modifications are combined with any modification that increases the presence of saturated fatty acids in the fungal cell by downregulation of endogenous desaturases. In a preferred embodiment, the fungal cell is *Saccharomyces cerevisiae* and the endogenous desaturases is OLE1. In another preferred embodiment, the fungal cell is *Yarrowia lipolytica* and the endogenous desaturase is selected from the group consisting of: YALI0_C05951g and YALI0B10153g. In a preferred embodiment, endogenous desaturase genes are de-regulated so that their expression and/or activity during the production phase is lower than the endogenous expression and/or activity during this production phase of a non-de-regulated control. Such de-regulation could be achieved via promoter replacement or via other means as described above.

In an embodiment, the fungal cell is genetically modified for deletion or downregulation of endogenous GPAT, LPAT and/or DGAT. In a preferred embodiment, the fungal cell is *Saccharomyces cerevisiae* and the endogenous GPAT to be downregulated or deleted is SCT1 and/or GPT2. In another preferred embodiment, the fungal cell is *Saccharomyces cerevisiae* and the endogenous LPAT to be downregulated or deleted is SLC1 and/or ALE1. In a further preferred embodiment, the fungal cell is *Saccharomyces cerevisiae* and the endogenous DGAT to be downregulated is DGA1.

In an embodiment, the fungal cell is genetically modified for enhanced activity of an acetyl-CoA carboxylase, preferably ACC1 (SEQ ID NO: 146), or an acetyl-CoA carboxylase having at least 70% sequence identity, preferably at least 80% sequence identity, and more preferably at least 90% sequence identity to SEQ ID NO: 146. This may be achieved via overexpression of ACC1 and/or via expression or overexpression of a mutant ACC1 variant with higher activity. Illustrative, but non-limiting, example of such mutant ACC1 variants include ACC1 from *Saccharomyces cerevisiae*, in which serine 659 in SEQ ID NO: 146 and/or serine 1157 in SEQ ID NO: 146 is/are replaced with another amino acid, preferably alanine.

In an embodiment, the fungal cell is a fungal cell selected from a group consisting of *Saccharomyces, Kluyveromyces, Zygosaccharomyces, Candida, Hansenula, Torulopsis, Kloeckera, Pichia, Schizosaccharomyces, Trigonopsis, Brettanomyces, Debaromyces, Nadsonia, Lipomyces, Cryptococcus, Aureobasidium, Trichosporon, Lipomyces, Rhodotorula, Yarrowia, Rhodosporidium, Phaffia, Schwanniomyces, Aspergillus* and *Ashbya*. In a particular embodiment, the fungal cell can be *Saccharomyces cerevisiae, Pichia pastoris, Ashbya gossypii, Saccharomyces boulardii, Zygosaccharomyces bailii, Kluyveromyces lactis,*

*Rhodosporidium toruloides* and *Yarrowia lipolytica. Saccharomyces cerevisiae* and *Yarrowia lipolytica* are preferred yeast species.

In an embodiment, the fungal cell is a yeast cell.

In an embodiment, the triacylglycerol species is selected from the group consisting of PPP, PPO, POP, POO, OPO, PPS, PSP, PSS, SPS, PPPo, PPoP, PPoPo, POS, PSO, OPS, POPo, PPoO, PSPo, PPoS, PoPPo, OOO, SOO, SSO, OSO, SOS, OOPo, OPoO, OPoPo, OSPo, OPoS, PoOS, PoOPo, SSS, SSPo, SpoS, PoSPo, PoPoPo, PoPoS, OPoO, BOB, BOO, OBO, BBB, AOA, AOO, OAO, AAA, POL, PoHO, MOP, PLO, MPO, PPL, SOL, MPS, MSS, MOO, LLL, OOPo, LOO, PMS, OPL, PSL, PLP, OLO, LLO, LLP. PoOL, PPoL, OLnL, OLnO, PPBu, OPBu, OOBu, PMBu, OPLa, PPC, PMCy, SMBu, BuOM, MMC, PBuL, MOCy, POCy, PCC, SOBu, PPC, CCO, MOH, OOCy, HLaO, MMBu, PLaBu, MLaH, PCH, MCCy and LaCC or a mixture of thereof.

In an embodiment, lipids isolated from the fungal cell described above can find various uses including, but not limited to, in plant-based meat products, in cultured cell-based meat products, in fermentation-based meat products, or in hybrid products. The isolated from the fungal cell described above may also be used in plant-based dairy products or in fermentation-based dairy products.

In an embodiment, the fungal cell is capable of producing more than 100 mg of triacylglycerols per L of culture medium, and/or more than 10 mg of triacylglycerols per g dry cell weight (DCW).

In a particular embodiment, the fungal cell is capable of producing more than 250 mg, preferably more than 500 mg, and more preferably more than 750 mg, such as more than 1 g of triacylglycerols per L of culture medium.

In an alternative or additional particular embodiment, the fungal cell is capable of producing more than 15 mg, preferably more than 25 mg, and more preferably more than 30 mg triacylglycerols per g DCW.

The above described embodiments may be combined.

An aspect of the invention relates to a method for producing triacylglycerols. The method comprises culturing a fungal cell according to any of the embodiments in a culture medium and in culture conditions suitable for production of the triacylglycerols by the fungal cell. The method also comprises collecting the triacylglycerols product from the culture medium and/or the fungal cell.

In an embodiment, the culture medium is nitrogen-limited.

In an embodiment, the triacylglycerol production process is composed of a growth phase, where the fungal cell is cultivated in the presence of high levels of the carbon source, e.g., glucose, and a production phase, where the fungal cell is cultivated in limiting conditions of the carbon source. This can be achieved, for example, in a fed-batch process.

EXAMPLES

Example 1: Expression of Specific Lipases Leads to Altered Triacylglycerol Composition in Fungal Cells Increasing the Content of Very Long-Chain Fatty and Saturated Acids within Triacylglycerols This example demonstrates how overexpression of a specific lipase in a fungal cell can alter the triacylglycerol (TAG) composition to increase production of desired TAGs. While our original target TAG characteristic was TAGs containing very long-chain fatty acids, we also found lipases applicable to production of saturated TAGs.

In particular, in this example lipases with sn-1,3 activity were tested. We identified the *Y. lipolytica* Lip2 lipase XP_500282.1 (YlLip2, SEQ ID NO: 12), the human pancreatic lipase NP_000927.1 (PNLP, SEQ ID NO: 11), the *Candida rugosa* Lip1 lipase P20261.3 (CrLip1, SEQ ID NO: 39), and the *Moesziomyces antarcticus* CALB lipase with the GenBank number P41365.1 (CALB) as potential candidates. Most characterized lipases with the desired activity were extracellular lipases, and as such any existing secretion signals detected through SignalP 5.0 (Almagro Armenteros et al, 2019) or Signal-BLAST (Franks and Sippl, 2008) were excluded from the cloned sequence. The respective codon-optimized sequences are shown in SEQ ID NO: 148-151. All sequences also included a kozak (AAAACA) sequence before the start codon.

Genetic modifications in yeast were carried out via promoter replacement, deletion of genes, integration of expression cassettes and use of expression plasmids. Standard molecular biology methods were used, including the use of integration cassettes, use of the selective markers Ura, His, Amds and Kanamycin and marker loop out as described in (David and Siewers, 2015).

As background yeast strain, the strain TY035 (Yu et al, 2017) was used, with the exception that the AtFAR gene was deleted from the strain. This resulted in strain TP01, containing modifications providing increased amount of very long-chain fatty acyl-CoAs. These modifications include overexpression of constitutively active version of ACC1, deletion of ELO3, and overexpression of ELO1 and ELO2.

The codon-optimized synthetic genes for *Saccharomyces cerevisiae* coding for these lipases were individually cloned into a p416GAL plasmid (Mumberg et al, 1994) under the control of a GAL1 promoter (pGAL1) and CYC1 terminator and transformed into TP01 using the Lithium/acetate method (Gietz and Schiestl, 2007).

*S. cerevisiae* strains with auxotrophies were grown on YPD plates containing 20 g/L glucose, 10 g/L yeast extract, 20 g/L peptone from casein and 20 g/L agar. URA3 plasmid carrying strains were grown on selective growth medium containing 6.9 g/L yeast nitrogen base without amino acids (Formedium, Hunstanton, UK), 0.77 g/L complete supplement mixture without uracil (Formedium), 20 g/L glucose and 20 g/L agar. Shake flask cultivations were performed in minimal medium containing 20 g/L glucose, 1 g/L galactose, 5 g/L (NH4)2SO4, 14.4 g/L KH2PO4, 0.5 g/L MgSO$_4$·7H$_2$O adjusted to pH 6. After sterilization, 2 mL-L-1 trace element solution and 1 mL/L of vitamin solution were added. The composition of the trace element and vitamin solution has been reported earlier (Verduyn et al, 1992).

Biological triplicates were pre-cultivated in 5 mL minimal medium at 200 rpm and 30° C. for 18 h. Subsequently, the pre-culture was diluted into 15 mL minimal medium in a 100 mL shake flask to an OD600 of 0.1. Shake flasks were incubated at 200 rpm and 30° C. for 72 h. A spectrophotometer (Genesis 20, Thermo Fisher Scientific, Waltham, MA, USA) was used to measure cell density at the end of the shake flask cultivations. After 72 h of culture, samples from each culture were analyzed for lipidomics using UHPLC-QTOF/MS and MS/MS analysis as further outlined below.

Samples for lipid analysis were taken at the end of the shake flask cultivations. The samples were centrifuged at 3000 g for 5 minutes and the supernatant was discarded. Cell pellets were then washed with 50 mL deionized water, centrifuged at 3000 g for 5 minutes and the supernatant was discarded. The pellets were kept at −20° C. for 10 min and then freeze-dried using a Christ alpha 2-4 LSC (Christ Gefriertrocknungsanlagen, Osterode, Germany). Fatty acids were extracted using microwave extraction and analyzed by GC-MS using 10 mg of dried cell biomass as previously described (Khoomrung et al, 2012; Folch et al, 1957).

The samples were spiked prior to lipid extraction and the extracts were diluted with an equal volume of chloroform: methanol (2:1 v/v) prior to injection.

A quality control sample (QC) pool was prepared by pooling an equal volume aliquot of each sample and was injected prior sample injection for column conditioning. Prior to data acquisition the instrument performance was verified by using three consecutive injections of cholesteryl alcohol for verifying mass accuracy, demonstrating that the HRMS data was better than 2.1 ppm. The relative standard deviations (RSDs) of area and retention time were calculated by using the internal standards from nine consecutive injections and were accepted with 510% and 50.2%, respectively.

Triacylglycerols (TAGs) of interest were detected and quantified using an Agilent Infinity 1290 ultra high performance liquid chromatography (UHPLC) system coupled to an Agilent 6520 quadrupole-time-of-flight (qTOF) mass spectrometer (both from Agilent technologies Inc., USA). The lipids were separated in a Acquity UPLC BEH C18 1.7 μm (2.1×100 mm) (Waters Corp, USA) column using aqueous mobile phase A (MPA) with 1 M ammonium acetate and 0.1% formic acid and mobile phase B (MPB) 1:1 v/v, MeCN: 2-propanol with 1 M ammonium acetate and 0.1% formic acid. Gradient elution program was as follows: 35% MPB ramped to 80% over the first 2 min, then ramped to 100% over the next 5 min and held at 100% until 18 min. The flow rate was 0.4 mL/min and the column was temperature controlled at 50° C. The mass spectra were acquired by using a Dual ESI source in positive ionization mode and scanning at 1.67 spectra/s over a mass range of 100-1700 m/z. The capillary voltage was set at 3500 V, the nebulizer at 45 psig and the gas temperature and flow at 175° C. and 10 L/min, respectively. MS data were acquired with Mass-Hunter Workstation Data Acquisition.

For the detection and quantification, a library of 40 TAGs of interest was built using MassHunter Personal Compound Database Library (PCDL) software. The same library was utilized for batch targeted feature extraction algorithm of MassHunter Profinder (Agilent Technologies). The feature extraction score was weighted based on mass (100%), isotopic abundance (60%) and isotopic space (50%) accuracies and the mass tolerance was at ±5 ppm.

Three different internal standards (15:0/15:0/15:0, 17:0/17:0/17:1 D5 and 20:0/20:1/20:0 D5) were spiked into the samples and calibration curve standards. Relative quantification of the TAGs was done by using calibration curves of three quantification standards (TAG 16:0/16:0/16:0, TAG 18:0/18:0/18:0, and TAG 22:0/18:1/22:0) spanning over a range of 0.1 to 1 μg/mL. The calibration TAG standard was selected individually for each of the 40 TAGs of interest based on their retention time.

Different TAG species are analyzed and displayed in the figures according to their total number of carbons based on the fatty acid species within this TAG and total number of double bonds within these fatty acids. For example a TAG with three palmitoleic acid fatty acid chains (C16:1) would be numbered as 48:3. The combinations of detected fatty acids within these TAGs are summarized in Table 2a-2d.

This data set is based on MSMS analysis of selected masses TG(48:0) to TG(68:3). MS scan m/z 70-1700 was done collecting 3 scan/s, with collusion energy of 40V. The adduct [M+NH$_4$]+ was selected, since the MSMS spectrum can tell about present fatty acids. For the MSMS analysis Agilent MassHunter Qualitative Analysis B.07.00 was used. MSMS spectra were picked using "Find compounds using auto MSMS" feature. For preliminary identity suggestions the peaks were searched against a database. Every MSMS spectrum was then manually checked. The intensities of fragments from loss of FA was noted ($=[TG+NH_4]+-(FA+NH_3)$). The amount of double bonds within the fatty acids was identified, but not the positions.

Figure 3A:
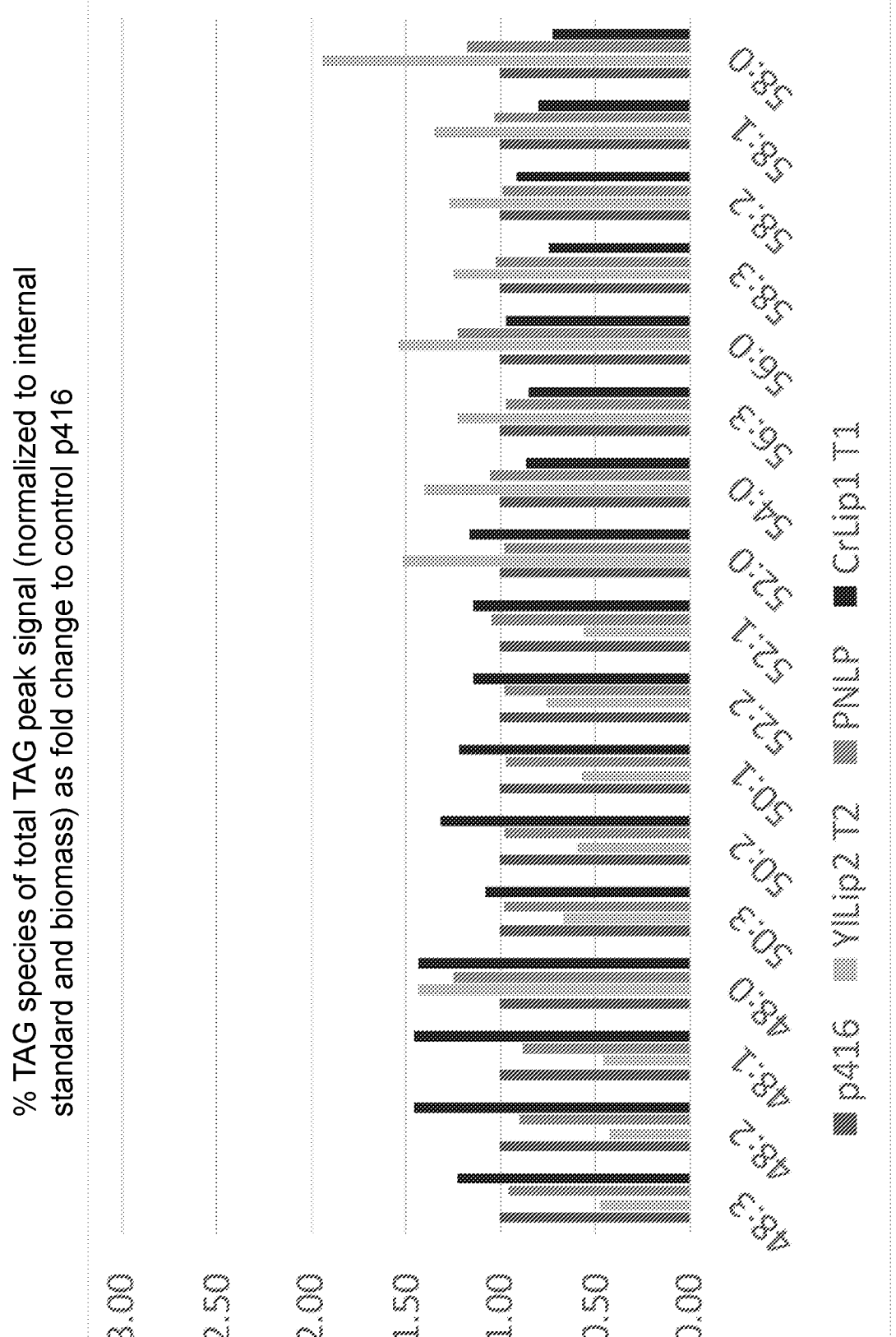
FIG. 3. Effect of lipase expression on production of different TAGs. Different lipases under control of the GAL1 promoter (pGAL1) on p416 plasmids were expressed in the background strain TP01; an empty p416 plasmid (without lipase) was used as control. The data is displayed as % TAG species of total TAG peak signal (normalized to internal standard and biomass) as fold change to control p416 (empty plasmid). Yarrow *lipolytica* Lip2 lipase XP_500282.1 is designated as "YlLip2 T2", the human pancreatic lipase NP_000927.1 is designated as "PNLP", and the *Candida rugosa* Lip1 lipase is designated as "CrLipT1". (A) display of TAG species 48:3 to 58:0 and (B) display of TAG species 60:3 to 68:1.
Figure 3B:
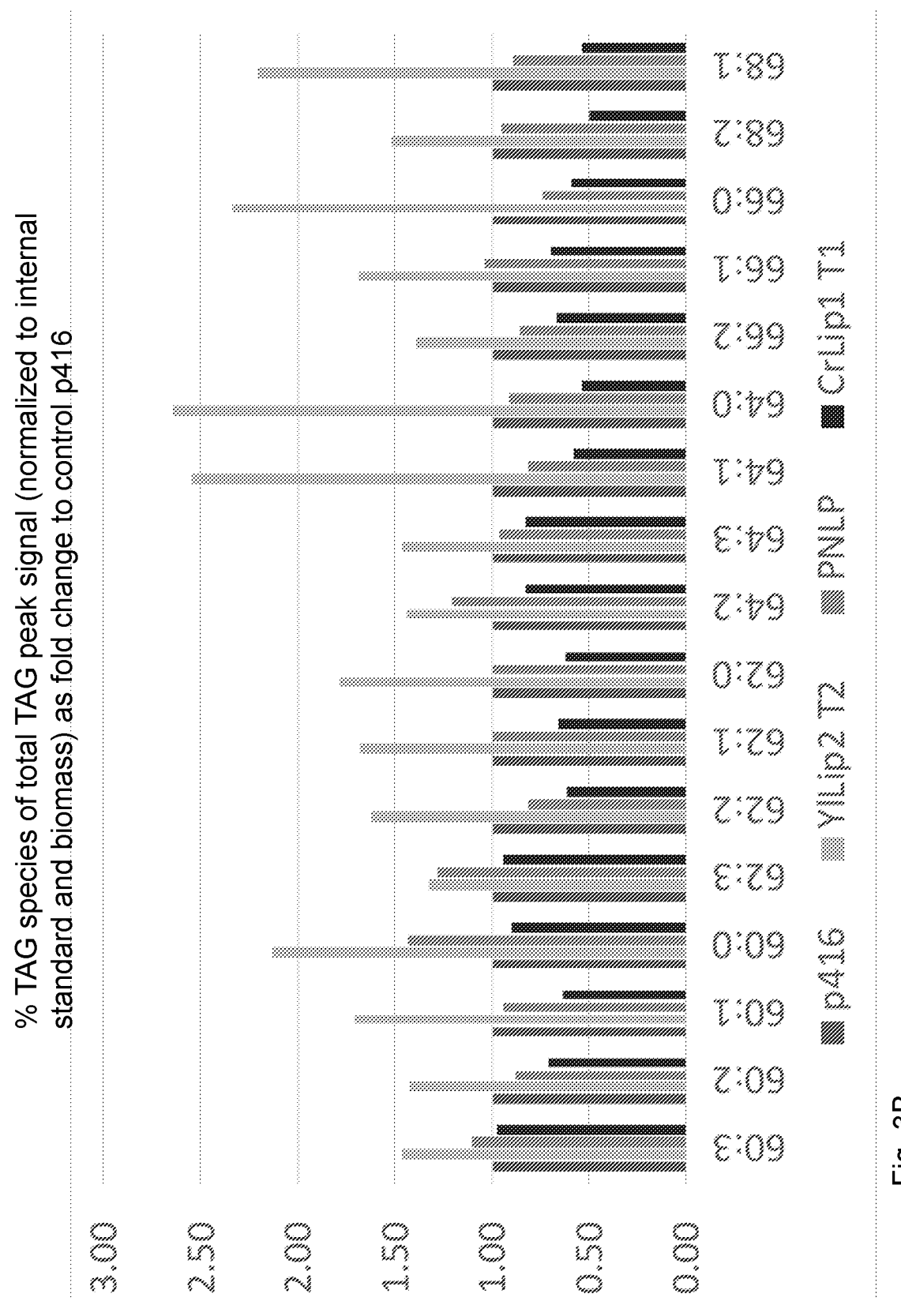

The results are shown in FIGS. 3A and 3B. TAG species containing only long-chain (C16 and C18) fatty acids can have a maximum size of 54 carbons (excluding the glycerol backbone), and more commonly, 48-50 carbons. TAGs incorporating at least one very long-chain fatty acid may have 52-54 carbons, while TAGs having 56 or more carbons definitely have at least one very long-chain fatty acid. TAGs with 60 or more carbons have at least 2 very long-chain fatty acids incorporated.

We found that *Y. lipolytica* Lip2 (SEQ ID NO: 12) was particularly useful for production of very long-chain TAGs. FIG. 3A shows that expression of YlLip2 leads to reduction in TAG species of 48:3, 48:2, 48:1, 50:3, 50:2, 50:1 consisting of combinations of C16:0, C16:1, C18:0 and C18:1 fatty acids (long-chain fatty acids). Detected TAG species which include very long-chain fatty acids (C20:0, C20:1, C22:0, C22:1, C24:0 or C24:1) are 52:0, 54:0, 56:0, 60:1, 62:1, 64:1, 64:0, 66:0, 68:1 etc. These were shown to increase when expressing YlLip2 (FIGS. 3A and 3B).

Surprisingly, despite decreasing the contents of unsaturated C48, C50, and C52 TAGs, expression of YlLip2 resulted in increase in the number of all saturated TAGs measured (48:0, 52:0, 54:0, 56:0, 58:0, 60:0, 62:0, 64:0, 66:0; FIGS. 3A and 3B)). This suggests that in addition to being a useful lipase to enrich for TAGs containing very-long chain species, this lipase might also be useful for increasing the number of saturated TAGs (e.g., to create meat-like TAGs). The TAG profile in FIG. 3 suggests that YlLip2 acts predominantly on unsaturated long-chain fatty acids within TAGs and displays reduced activity on saturated and very long-chain fatty acids within TAGs.

PNLP had a modest effect on increasing TAGs containing very long-chain fatty acids, increasing levels of 58:0, 60:3, 60:0, 62:3 and 64:2. Interestingly, PNLP also had a positive effect on production of saturated TAGs, increasing levels of 48:0, 56:0, 58:0, and 60:0 (FIG. 3).

CrLip1 only had a mild effect on production of TAGs with very long-chains, with increases in only 52:0, 52:2, and 52:1 observed. In addition, there was a significant increase in 48:0, which could indicate potential applications of this lipase to increase TAGs with higher saturation (particularly PPP species) (FIG. 3).

CALB showed no beneficial activity for production of very long-chain TAGs.

TABLE 1a

Analysis of different TAG species according to their main ions for lipase expressing strains based on MS/MS analysis (TG 48:0 until 62:0)

| | TG 48:0 | TG 50:0 | TG 52:0 | TG 54:0 | TG 56:0 | TG 58:0 | TG 60:0 | TG 62:0 | >64 no MS-MS ions |
|---|---|---|---|---|---|---|---|---|---|
| Main Ions | 16:0-<br>16:0-<br>16:0<br>Some<br>10:0-<br>16:0-<br>22:0 | 12:0-<br>16:0-<br>22:0<br>16:0-<br>16:0-<br>18:0 | 12:0-<br>18:0-<br>22:0<br>16:0-<br>16:0-<br>20:0 | 16:0-<br>16:0-<br>22:0<br>16:0-<br>18:0-<br>20:0 | 16:0-<br>18:0-<br>22:0 | | | 18:0-<br>22:0-<br>22:0 | |
| Comments | | | | | very low GC-MS signal | very low GC-MS signal | | very low GC-MS signal | no Ions |

TABLE 1b

Analysis of different TAG species according to their main ions for lipase expressing strains based on MS/MS analysis (TG 48:1 until 64:1)

| | TG 48:1 | TG 50:1 | TG 52:1 | TG 54:1 | TG 56:1 | TG 58:1 | TG 60:1 | TG 62:1 | TG 64:1 | >64 no MS-MS ions |
|---|---|---|---|---|---|---|---|---|---|---|
| Main Ions | 16:1-<br>16:0-<br>16:0 | 16:1-<br>16:0-<br>18:0<br>16:0-<br>16:0-<br>18:1 | Range:<br>FA C16<br>to C22 | 16:1-<br>16:0-<br>22:0<br>16:1-<br>16:0-<br>18:1<br>16:0-<br>18:1-<br>20:0 | 16:1-<br>18:0-<br>22:0<br>16:1-<br>16:0-<br>18:1<br>20:0<br>22:0 | 18:1-<br>18:0-<br>22:0 | 16:1-<br>22:0-<br>22:0<br>18:1-<br>20:0-<br>22:0<br>16:1-<br>20:0-<br>24:0 | 18:1-<br>22:0-<br>22:0 | 18:1-<br>24:0-<br>22:0 | |
| Minor ions | | | Minor;<br>range:<br>FA from<br>10 to 22 | | 16:1-<br>16:0-<br>24:0<br>18:1- | 16:1-<br>20:0-<br>22:0 | | | | |

TABLE 1b-continued

Analysis of different TAG species according to their main ions for lipase
expressing strains based on MS/MS analysis (TG 48:1 until 64:1)

| TG 48:1 | TG 50:1 | TG 52:1 | TG 54:1 | TG 56:1 | TG 58:1 | TG 60:1 | TG 62:1 | TG 64:1 | >64 no MS-MS ions |
|---|---|---|---|---|---|---|---|---|---|
| | | | | 18:0-20:0 | 16:1-18:0-24:0 16:0-18:1-24:0 | | | | |

TABLE 1c

Analysis of different TAG species according to their main ions for lipase
expressing strains based on MS/MS analysis (TG 48:2 until 64:2)

| | TG 48:2 | TG 50:2 | TG 52:2 | TG 54:2 | TG 56:2 | TG 58:2 | TG 60:2 | TG 62:2 | TG 64:2 | >64 no MS-MS |
|---|---|---|---|---|---|---|---|---|---|---|
| Main Ions | 16:1-16:1-16:0 | 16:1-16:1-18:0 16:1-18:1-16:0 | 16:1-18:1-18:0 18:1-18:1-16:0 | 16:1-16:1-22:0 18:1-18:1-18:0 | 16:1-16:1-22:0 | 18:1-18:1-22:0 16:1-18:1-24:0 | 18:1-18:1-24:0 18:1-20:1-22:0 16:1-22:1-22:0 | | | |
| Minor ions | 16:1-18:1-14:0 | | | 16:1-16:1-20:0 | 16:1-18:1-20:0 | 16:1-16:1-24:0 | | | | |
| Comments | | | | | | | | very low GC-MS signal | very low GC-MS signal | |

TABLE 1d

Analysis of different TAG species according to
their main ions for lipase expressing strains
based on MS/MS analysis (TG 48:3 until 62:3)

| | TG 48-52:3 | TG 54:3 | TG 56:3 | TG 58:3 | TG 60:3 | TG 62:3 |
|---|---|---|---|---|---|---|
| Main Ions | Mostly 18:1 and 16:1 Combinations | 18:1-18:1-18:1 16:1-18:1-20:1 | 16:1-18:1-22:1 18:1-18:1-20:1 | 16:1-18:1-24:1 18:1-18:1-22:1 | | |
| | Some 20:1 in 52:3 | 16:1-16:1- | | | | |
| Minor ions | | 22:1 | 16:1-16:1-24:1 | | | |
| Comments | | | | | very low GC-MS signal | very low GC-MS signal |

Example 2: Expression of Specific DGATs Leads to Altered Composition of TAGs in Fungal Cells Increasing the Content of Very Long-Chain Fatty and Saturated Acids in TAGs This example demonstrates how overexpression of specific diacylglycerol acyltransferases (DGATs) in a fungal cell can alter the triacylglycerol (TAG) composition to increase production of TAGs containing very long-chain fatty acids.

To find DGATs active on very long-chain fatty acids we screened different genes coding for DGATs with plant and bacterial origin. For this screening, we selected four DGAT1 protein sequences from plants, including three DGAT1 sequences from *Brassica napus*: NP_001303201.1 (BnDGAT1-1, SEQ ID NO: 7), NP_001302852.1 (BnDGAT1-2, SEQ ID NO: 8) and NP_001302732.1 (BnDGAT1-3, SEQ ID NO: 9) and a DGAT1 from *Tropaeolum majus* AAM03340.2 (TmDGAT, SEQ ID NO: 10). We also selected bacterial sequences for this screening process, in particular a wax-ester synthase/DGAT enzyme WP_004922247.1 from *Acinetobacter calcoaceticus* (AcWS) and DGAT sequences from four different *mycobacterium* species (*Mycobacterium rhodesiae* WP_014208498.1, *Mycobacterium aurum* WP_048633004.1, *Mycobacterium diernhoferi* WP_073856376.1 and *Mycobacterium vaccae* WP_003929124.1. All accession numbers given above are for GenBank. The synthetic genes for these sequences were codon optimized for *S. cerevisiae* and individually cloned into a p416GAL plasmid under the control of a GAL1 promoter and CYC1 terminator using BamHI/XhoI. The respective sequences of the codon-optimized genes are SEQ ID NO: 152-160. All sequences also included a kozak (AAAACA) sequence before the start codon.

*S. cerevisiae* derived DGAT (DGA1, GenBank: NM_001183664.1) was cloned in the same plasmid as a control as above. The plasmids were transformed into a new strain TP02, which was derived from TP01 by deleting the native DGA1 gene. The cells were grown in liquid culture in the presence of glucose and galactose. After 72 h of culture, samples from each culture were analyzed for lipidomics using UHPLC-QTOF/MS analysis. All genetic modifications, cultivations, and analysis were performed as described in Example 1.

Figure 4:
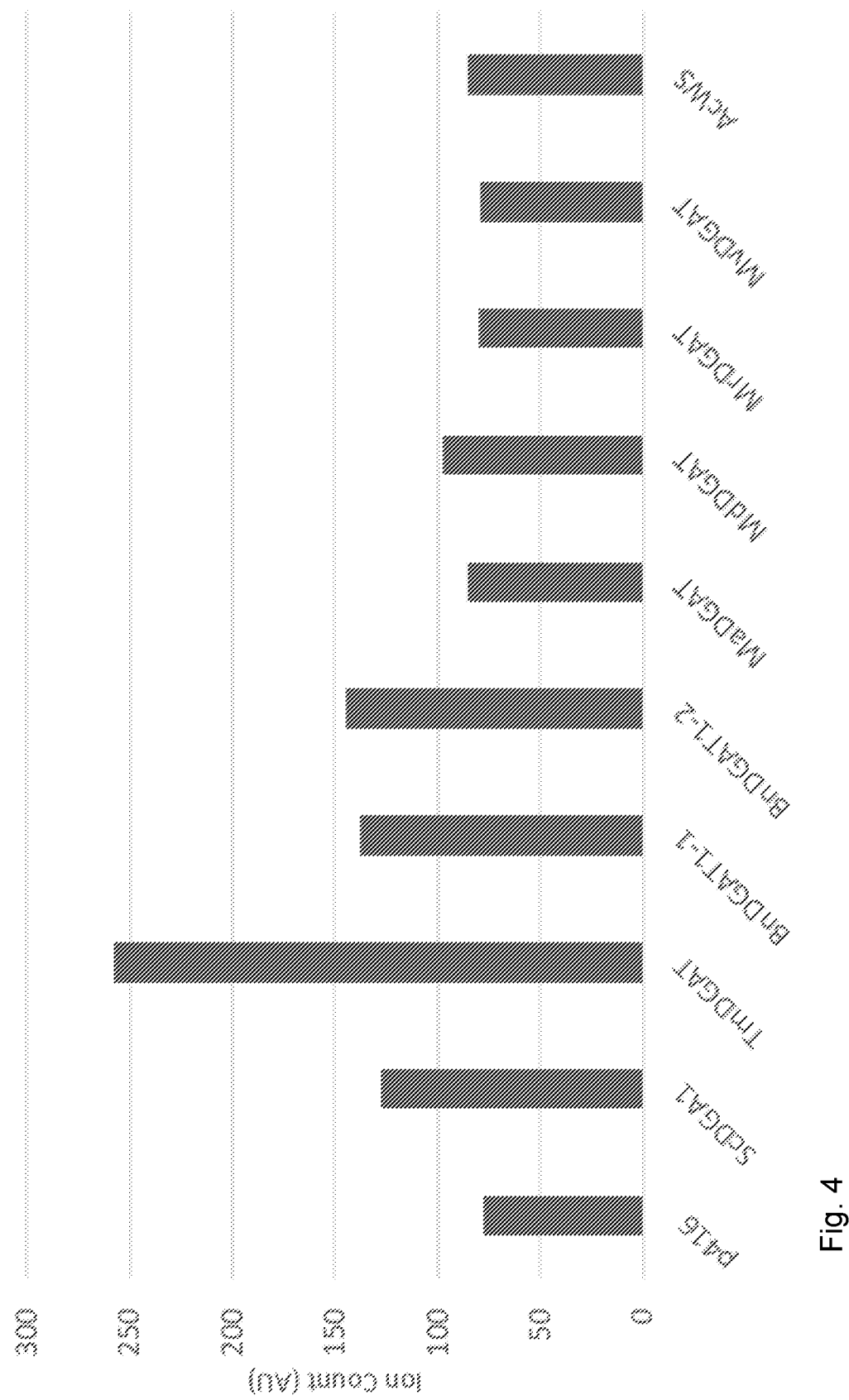
FIG. 4. Effect of expression of different DGATs on total TAG production. Total ion count of all the TAG species normalized by the biomass and internal standard of each sample. The values are an indication of the relative amount of TAG molecules in each sample. All DGATs were expressed under GAL1 promoter control in the plasmid backbone of p416 in the strain background TP02. The empty plasmid p416 was used as a control.

Interestingly, expression of TmDGAT significantly increased production of TAGs in general compare to yeast native DGAT (ScDGA1) and other DGATs (FIG. 4).

Figure 5A:
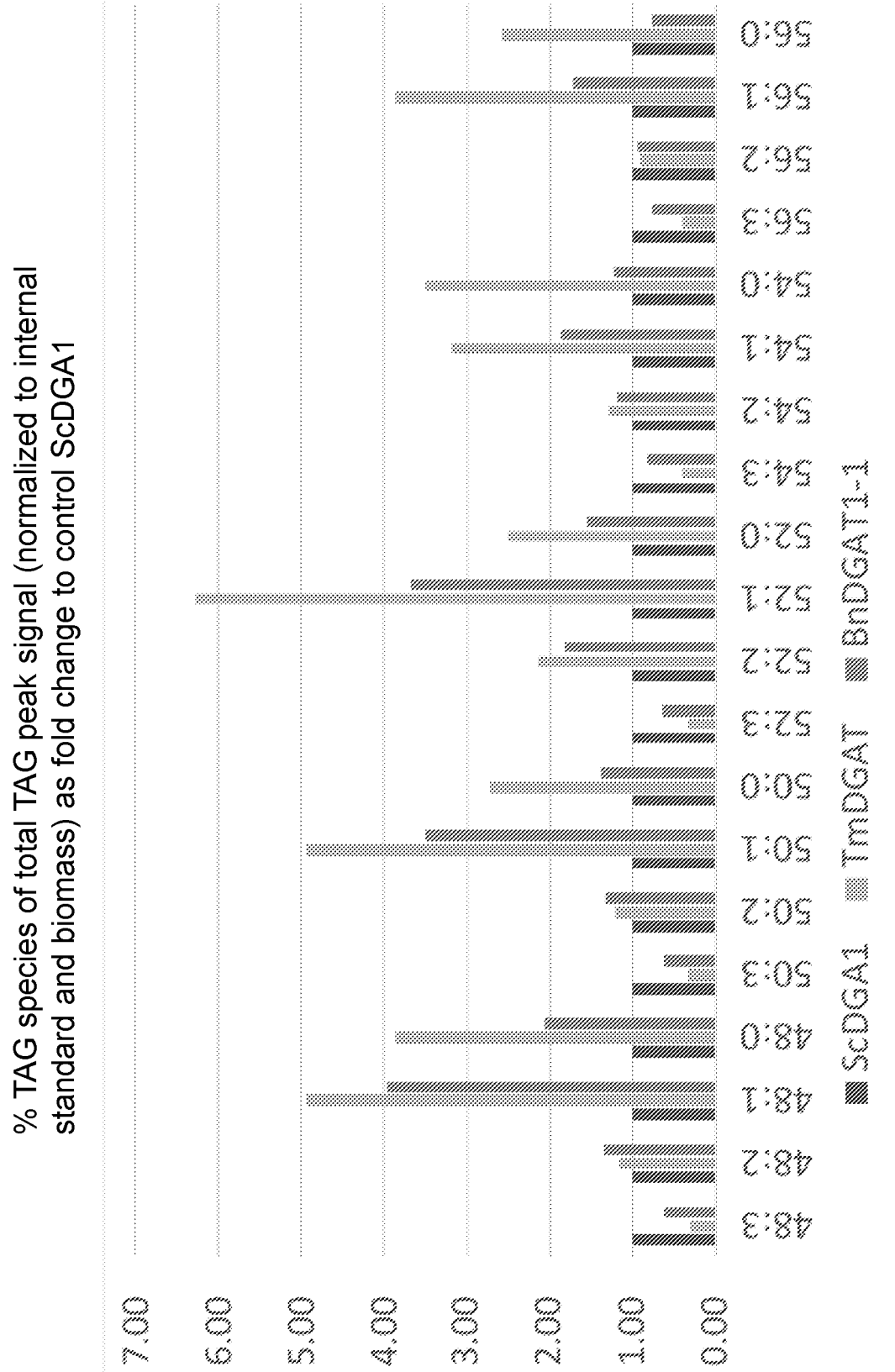
FIG. 5. Effect of expression of different DGATs on production of different TAGs. Different DGATs under control of pGAL1 on p416 plasmids were expressed in the background strain TP02; the native DGAT from *Saccharomyces cerevisiae* was used as control, expressed under pGAL1 promoter in the p416 plasmid background. The data is displayed as % TAG species of total TAG peak signal (normalized to internal standard and biomass) as fold change to the control (*S. cerevisiae* DGA1). (A) display of TAG species 48:3 to 56:0 and (B) display of TAG species 58:3 to 68:1.
Figure 5B:
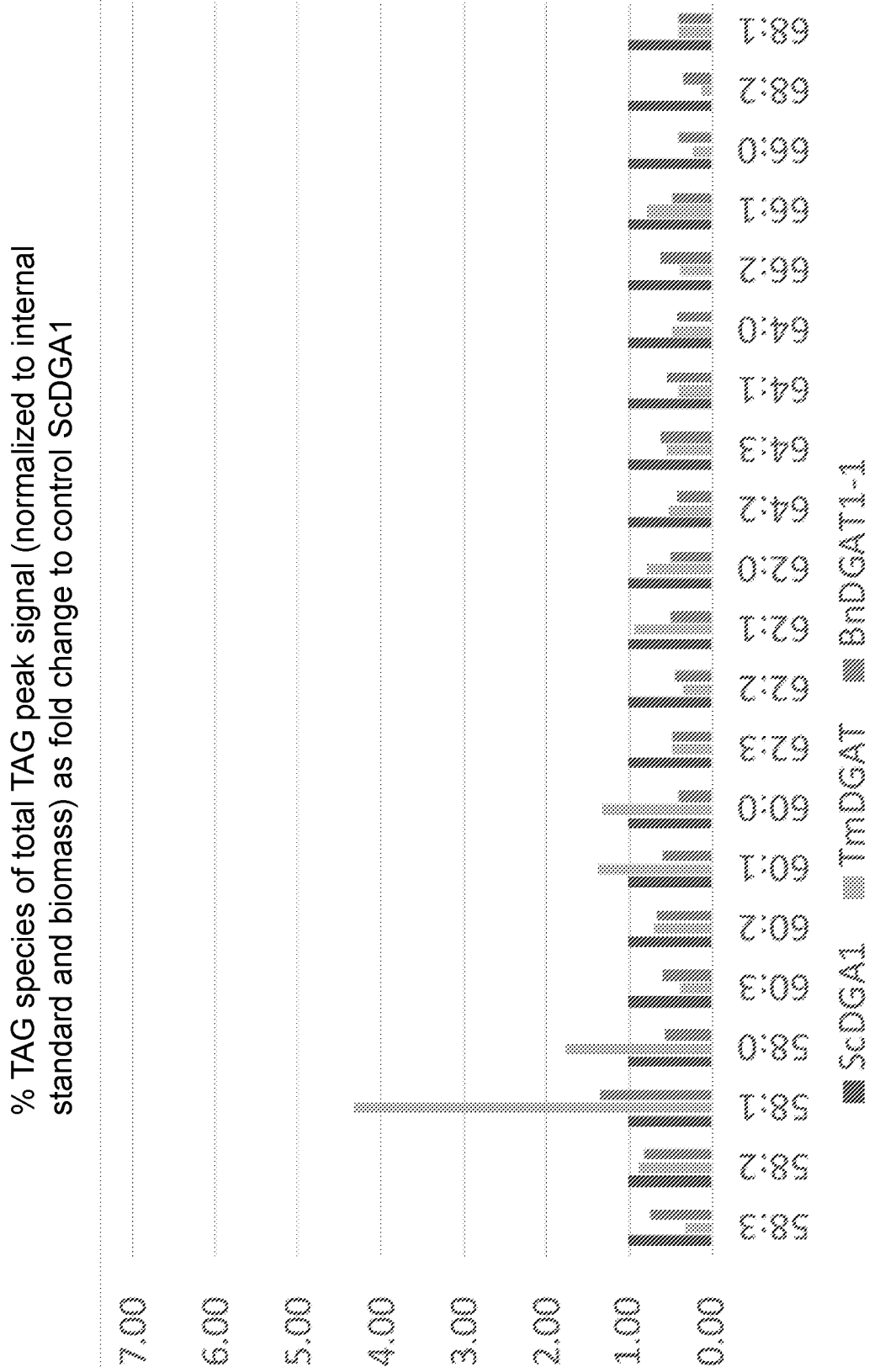

Strains expressing TmDGAT were further analyzed for their TAG composition. The results show that expressing the specific TmDGAT leads to significant increase in TAG species which are likely to have very long-chain fatty acids incorporated, such as 52:2, 52:1, 52:0, 54:1, and 54:0; as well as TAG species that definitely have very long-chain fatty acids incorporated such as 56:1, 56:0, 58:1, and 60:0 (FIG. 5A, 5B). These TAG species include very long-chain fatty acids like C20:0, C20:1, C22:0, C22:1, C24:0 or C24:1 (Table 3a-3d). BnDGAT1-1 showed similar effects put these were less pronounced.

In addition, expression of TmDGAT increased species such as 48:1, 48:0, 50:1, 50:0. These results suggest it to be a promising DGAT for production of additional types of TAGs. For example, the increase in species such as 48:0, 52:0, and 54:0 suggest that TmDGAT might be relevant for producing saturated TAGs (e.g. meat-like TAGs).

Expression BnDGAT1-1 significantly increased the species 48:1, 48:0, 50:1, 52:2, 52:1, 52:0, 54:1, 56:1, and 58:1.

TABLE 2a

| | Ion count of specific TAG species for strains expressing different DGATs and total TAG signal normalized to biomass and internal standard | | | | | |
|---|---|---|---|---|---|---|
| TAG species | TP02, p416 | TP02, BnDGAT1-1 | TP02, BnDGAT1-2 | TP02, AcWS | TP02, TmDGAT | TP02, ScDGA1 |
| 48:3 | 23.20 | 19.30 | 21.96 | 18.59 | 17.45 | 28.09 |
| 48:2 | 3.51 | 13.76 | 14.56 | 8.70 | 22.06 | 9.32 |
| 48:1 | 0.25 | 5.63 | 5.98 | 2.58 | 13.17 | 1.34 |
| 48:0 | 0.11 | 0.79 | 0.73 | 0.22 | 2.80 | 0.35 |
| 50:3 | 25.68 | 18.31 | 21.23 | 18.87 | 17.23 | 26.86 |
| 50:2 | 3.84 | 13.91 | 13.90 | 9.65 | 23.53 | 9.78 |
| 50:1 | 0.18 | 5.43 | 5.84 | 2.66 | 14.42 | 1.47 |
| 50:0 | 0.04 | 0.63 | 0.58 | 0.17 | 2.32 | 0.42 |
| 52:3 | 10.59 | 6.89 | 7.78 | 7.26 | 6.58 | 9.80 |
| 52:2 | 1.11 | 7.02 | 7.40 | 3.69 | 15.28 | 3.62 |
| 52:1 | 0.11 | 3.82 | 3.66 | 1.42 | 12.28 | 0.99 |
| 52:0 | 0.03 | 0.36 | 0.30 | 0.10 | 1.10 | 0.22 |
| 54:3 | 1.94 | 1.72 | 1.82 | 1.33 | 1.59 | 1.97 |
| 54:2 | 2.23 | 11.91 | 11.96 | 3.70 | 24.12 | 9.41 |
| 54:1 | 0.24 | 7.05 | 6.41 | 1.18 | 22.45 | 3.52 |
| 54:0 | 0.02 | 0.31 | 0.23 | 0.04 | 1.65 | 0.23 |
| 56:3 | 0.67 | 0.59 | 0.61 | 0.45 | 0.56 | 0.72 |
| 56:2 | 2.30 | 9.06 | 9.54 | 2.63 | 16.37 | 9.04 |
| 56:1 | 0.20 | 5.33 | 4.34 | 0.73 | 22.48 | 2.94 |
| 56:0 | 0.02 | 0.12 | 0.10 | 0.04 | 0.79 | 0.15 |
| 58:3 | 0.33 | 0.22 | 0.26 | 0.20 | 0.18 | 0.29 |
| 58:2 | 0.85 | 2.43 | 2.57 | 0.74 | 4.91 | 2.80 |
| 58:1 | 0.09 | 1.31 | 1.07 | 0.24 | 7.85 | 0.90 |
| 58:0 | 0.01 | 0.04 | 0.03 | 0.01 | 0.22 | 0.06 |
| 60:3 | 0.06 | 0.04 | 0.05 | 0.04 | 0.05 | 0.07 |
| 60:2 | 0.15 | 0.27 | 0.29 | 0.11 | 0.52 | 0.38 |
| 60:1 | 0.12 | 0.67 | 0.57 | 0.13 | 2.92 | 1.07 |
| 60:0 | 0.01 | 0.02 | 0.02 | 0.01 | 0.15 | 0.06 |
| 62:3 | 0.02 | 0.01 | 0.01 | 0.01 | 0.02 | 0.02 |
| 62:2 | 0.05 | 0.06 | 0.07 | 0.04 | 0.09 | 0.12 |
| 62:1 | 0.09 | 0.43 | 0.36 | 0.10 | 1.47 | 0.80 |
| 62:0 | 0.03 | 0.11 | 0.09 | 0.03 | 0.33 | 0.21 |
| 64:2 | 0.00 | 0.00 | 0.00 | 0.00 | 0.01 | 0.01 |
| 64:3 | 0.03 | 0.05 | 0.05 | 0.03 | 0.08 | 0.08 |
| 64:1 | 0.05 | 0.11 | 0.07 | 0.03 | 0.15 | 0.19 |
| 64:0 | 0.01 | 0.03 | 0.03 | 0.01 | 0.05 | 0.06 |
| 66:2 | 0.01 | 0.02 | 0.02 | 0.01 | 0.02 | 0.02 |
| 66:1 | 0.02 | 0.09 | 0.07 | 0.02 | 0.29 | 0.18 |
| 66:0 | 0.00 | 0.00 | 0.00 | 0.00 | 0.01 | 0.01 |
| 68:2 | 0.00 | 0.00 | 0.01 | 0.00 | 0.00 | 0.01 |
| 68:1 | 0.01 | 0.02 | 0.02 | 0.01 | 0.03 | 0.04 |
| Total TAG | 78.22 | 137.88 | 144.60 | 85.79 | 257.58 | 127.60 |

TABLE 2b

Ion count of specific TAG species for strains expressing different DGATs and total TAG signal
normalized to biomass and internal standard (continuation)

| TAG species | TP02, MaDGAT | TP02, MdDGAT | TP02, MrDGAT | TP02, MvDGAT |
|---|---|---|---|---|
| 48:3 | 23.13 | 21.94 | 23.10 | 21.44 |
| 48:2 | 4.19 | 6.81 | 3.89 | 4.11 |
| 48:1 | 0.37 | 0.78 | 0.26 | 0.39 |
| 48:0 | 0.10 | 0.15 | 0.14 | 0.15 |
| 50:3 | 25.38 | 24.61 | 25.00 | 23.12 |
| 50:2 | 4.54 | 7.05 | 3.75 | 4.47 |
| 50:1 | 0.35 | 0.76 | 0.24 | 0.36 |
| 50:0 | 0.06 | 0.12 | 0.05 | 0.08 |
| 52:3 | 11.47 | 11.09 | 10.83 | 9.77 |
| 52:2 | 1.57 | 2.64 | 1.40 | 1.43 |
| 52:1 | 0.18 | 0.43 | 0.17 | 0.25 |
| 52:0 | 0.04 | 0.07 | 0.04 | 0.05 |
| 54:3 | 2.53 | 2.40 | 2.05 | 1.95 |
| 54:2 | 3.46 | 5.83 | 2.65 | 3.71 |
| 54:1 | 0.38 | 0.93 | 0.33 | 0.53 |
| 54:0 | 0.03 | 0.05 | 0.03 | 0.04 |
| 56:3 | 1.00 | 0.95 | 0.72 | 0.81 |
| 56:2 | 3.62 | 5.96 | 2.77 | 3.74 |
| 56:1 | 0.36 | 0.76 | 0.31 | 0.38 |
| 56:0 | 0.03 | 0.04 | 0.03 | 0.03 |
| 58:3 | 0.43 | 0.44 | 0.35 | 0.38 |
| 58:2 | 1.29 | 1.96 | 0.97 | 1.14 |
| 58:1 | 0.14 | 0.29 | 0.12 | 0.13 |
| 58:0 | 0.01 | 0.02 | 0.01 | 0.01 |
| 60:3 | 0.11 | 0.10 | 0.08 | 0.07 |
| 60:2 | 0.20 | 0.28 | 0.17 | 0.20 |
| 60:1 | 0.13 | 0.31 | 0.14 | 0.20 |
| 60:0 | 0.01 | 0.01 | 0.01 | 0.01 |
| 62:3 | 0.02 | 0.02 | 0.01 | 0.02 |
| 62:2 | 0.07 | 0.10 | 0.06 | 0.08 |
| 62:1 | 0.13 | 0.28 | 0.12 | 0.16 |
| 62:0 | 0.04 | 0.07 | 0.04 | 0.05 |
| 64:2 | 0.01 | 0.01 | 0.00 | 0.00 |
| 64:3 | 0.05 | 0.06 | 0.04 | 0.04 |
| 64:1 | 0.04 | 0.12 | 0.04 | 0.05 |
| 64:0 | 0.01 | 0.03 | 0.01 | 0.02 |
| 66:2 | 0.02 | 0.03 | 0.02 | 0.02 |
| 66:1 | 0.04 | 0.07 | 0.03 | 0.04 |
| 66:0 | 0.00 | 0.00 | 0.00 | 0.00 |
| 68:2 | 0.01 | 0.01 | 0.01 | 0.01 |
| 68:1 | 0.01 | 0.02 | 0.01 | 0.01 |
| Total TAG | 85.53 | 97.56 | 80.02 | 79.45 |

TABLE 3a

Analysis of different TAG species according to their main ions for DGAT
expressing strains based on MS/MS analysis (TG48:0 until TG 62:0)

| | TG 48:0 | TG 50:0 | TG 52:0 | TG 54:0 | TG 56:0 | TG 58:0 | TG 60:0 | TG 62:0 |
|---|---|---|---|---|---|---|---|---|
| Main Ions | 16:0- 16:0- 16:0 10:0- 16:0- 22:0 for some plant DGATs | 12:0- 16:0- 22:0 16:0- 16:0- 18:0 | 14:0- 16:0- 22:0 12:0- 18:0- 22:0 16:0- 16:0- 20:0 | | | | | |
| Comments | | Not detected in control | | low GC-MS signal | low GC-MS signal | low GC-MS signal | low GC-MS signal | low GC-MS signal |

65 66

TABLE 3b

Analysis of different TAG species according to their main ions for DGAT
expressing strains based on MS/MS analysis (TG48:1 until TG 64:1)

| | TG 48:1 | TG 50:1 | TG 52:1 | TG 54:1 | TG 56:1 | TG 58:1 | TG 60:1 | TG 62:1 | TG 64:1 | >64 no MS-MS |
|---|---|---|---|---|---|---|---|---|---|---|
| Main Ions | 16:1-<br>16:0-<br>16:0 | 16:1-<br>16:0-<br>18:0<br>16:0-<br>16:0-<br>18:1<br>Mycobac.has decent amount of 12:0-16:1-22:0, but plant DGATs don't | FA range C12 to C22 | 16:1-<br>16:0-<br>22:0 | 16:1-<br>18:0-<br>22:0<br>16:0-<br>18:1-<br>22:0 | 18:1-<br>18:0-<br>22:0 | 16:1-<br>22:0-<br>22:0 | 18:1-<br>22:0-<br>22:0 | 18:1-<br>24:0-<br>22:0 | |
| Minor possible ions | | | | | 16:1-<br>16:0-<br>24:0<br>18:1-<br>18:0-<br>20:0 | 16:1-<br>20:0-<br>22:0 | 18:1-<br>20:0-<br>22:0 | 16:1-<br>22:0-<br>24:0 | | |
| | | | | | | 16:1-<br>18:0-<br>24:0<br>16:0-<br>18:1-<br>24:0 | 16:1-<br>20:0-<br>24:0 | | | |
| Comments | | minor amount FA range from 10 to 22 | | | | | | | | |

TABLE 3c

Analysis of different TAG species according to their main ions for DGAT
expressing strains based on MS/MS analysis (TG 48:2 until TG 64:2)

| | TG 48:2 | TG 50:2 | TG 52:2 | TG 54:2 | TG 56:2 | TG 58:2 | TG 60:2 | TG 62:2 | TG 64:2 | >64 no MS-MS |
|---|---|---|---|---|---|---|---|---|---|---|
| Main Ions | 16:1-<br>16:1-<br>16:0 | 16:1-<br>16:1-<br>18:0 | 16:1-<br>18:1-<br>18:0<br>16:1-<br>18:1-<br>16:0 | 16:1-<br>16:1-<br>22:0<br>18:1-<br>18:1-<br>16:0 | 16:1-<br>18:1-<br>22:0 | 18:1-<br>18:1-<br>22:0<br>16:1-<br>18:1-<br>24:0 | 18:1-<br>18:1-<br>24:0<br>18:1-<br>20:1-<br>22:0<br>16:1-<br>22:1-<br>22:0 | | | |
| Minor possible ions | 16:1-<br>18:1-<br>14:0 | | 16:1-<br>16:1-<br>20:0 | 16:1-<br>18:1-<br>20:0 | 16:1-<br>16:1-<br>24:0 | | | | | |
| Comments | | | | | Lower 24:0 TAG in TmDGAT | Lower 24:0 TAG in TmDGAT | very low GC-MS signal | very low GC-MS signal | | |

TABLE 3d / TABLE 3d-continued

Analysis of different TAG species according to
their main ions for DGAT expressing strains based
on MS/MS analysis (TG48:3 until TG 62:3)

| | TG 48-52:3 | TG 54:3 | TG 56:3 | TG 58:3 | TG 60:3 | TG 62:3 |
|---|---|---|---|---|---|---|
| Main Ions | Only 18:1 and 16:1 Combinations | 18:1-<br>18:1-<br>18:1<br>16:1-<br>18:1-<br>20:1<br>16:1-<br>16:1-<br>22:1 | 16:1-<br>18:1-<br>22:1<br>16:1-<br>16:1-<br>24:1<br>18:1-<br>18:1-<br>20:1 | 16:1-<br>18:1-<br>24:1<br>18:1-<br>18:1-<br>22:1 | | |

55

60

65

TABLE 3d-continued

| | | | | | |
|---|---|---|---|---|---|
| Analysis of different TAG species according to their main ions for DGAT expressing strains based on MS/MS analysis (TG48:3 until TG 62:3) | | | | | |
| TG 48-52:3 | TG 54:3 | TG 56:3 | TG 58:3 | TG 60:3 | TG 62:3 |
| Comments | | | | very low GC-MS signal | very low GC-MS signal |

Example 3: Combination of Specific DGATs and GPATs Lead to Altered Composition of TAGs in Fungal Cells Increasing the Content of Very Long-Chain Fatty Acids This example demonstrates how overexpression of specific GPATs in a fungal cell can alter the triacylglycerol (TAG) composition to increase production of TAGs containing very long-chain fatty acids.

As a proof of concept, we focused on engineering the GPAT step, aiming to enrich the C22:0 chains in the sn-1 position of the TAG with at the same time expressing a very long chain fatty acid-specific DGAT identified in example 2 (TmDGAT). This strategy would promote the formation of position-specific dibehenate TAGs, with the structure behenate:X:behenate (di-behenyl TAGs) where X stands for any other fatty acid, most likely C16:0, C16:1, C18:0 or C18:1.

Different GPATs sequences from plants were selected. In plants, several families of GPATs exist with distinct functions associated. In *Arabidopsis thaliana*, there are genes from nine different GPAT families. Among these, we selected AEE27311.1 (AtGPAT4, SEQ ID NO: 5), NP_568925.1 (AtGPAT9) and from *Brassica napus* the following genes were selected: CDY15240.1 (BnGPAT2), CDY22016.1 (BnGPAT3, SEQ ID NO: 2**), NP_001302652.1 (BnGPAT6), CDY60435.1 (BnGPAT7, SEQ ID NO: 1) and CDY31526.1 (BNGPAT9, SEQ ID NO: 6). In addition, three genes from selected green algae species were tested: AFC93411.1 (CrGPAT9) from *Chlamydomonas reinhardtii*, GBF93567.1 (RsGPAT9, SEQ ID NO: 3) from *Raphidocelis subcapitata* RS9, and PSC73996.1 (McGPAT9, SEQ ID NO: 4) from *Micractinium conductrix*. All accession numbers listed above correspond to GenBank accession numbers. In the case of *Brassica napus GPAT3*, a truncated version of the GPAT encoding amino acids 68-434 of SEQ ID NO: 2 was evaluated (designated BnGPAT3**).

The synthetic genes were codon optimized for *S. cerevisiae* (SEQ ID NO: 161-171) and cloned and expressed from a p416GAL plasmid under the control of a GAL1 promoter. All sequences also included a kozak (AAAACA) sequence before the start codon. The plasmids were transformed into a new strain, TP03, which originated from integrating the TmDGAT1 gene under the control of a GAL1 promoter in the genome of TP02 in the LRO1 locus using an amdS cassette (replacing the LRO1 gene) as described by (Solis-Escalante et al., 2013). amdS was then looped out by plating on fluoroacetamide as described by (Solis-Escalante et al., 2013).

All genetic modifications, cultivations, and analysis were performed as described in Example 1.

We analyzed these samples using a targeted lipidomics approach with UHPLC-QTOF/MS. For the targeted approach, we detected and selected signals of TAG species containing C22:0 fatty acids.

Figure 6:
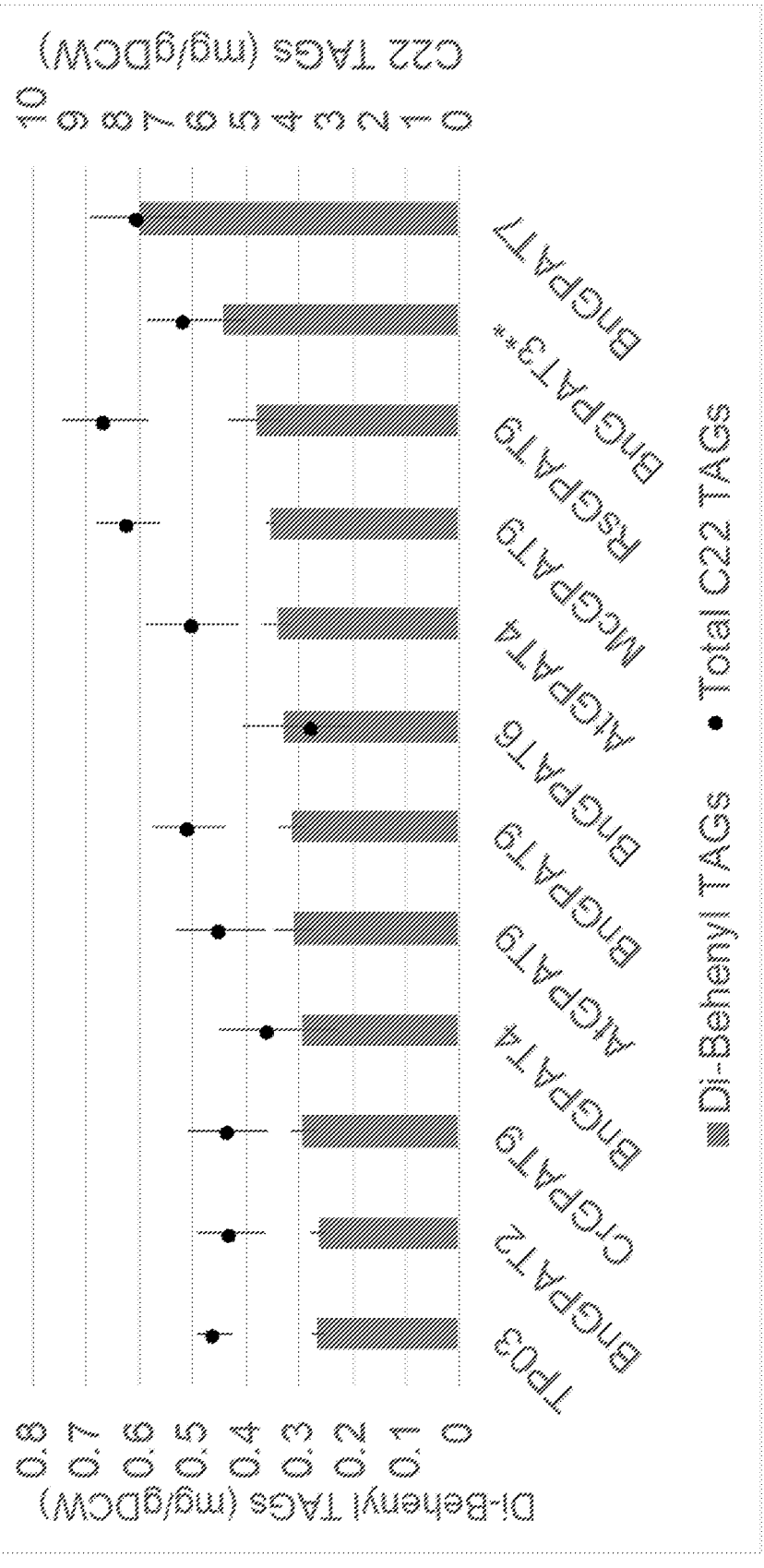
FIG. 6. Screening of GPAT genes through targeted very long-chain TAG quantification. Quantification of C22:0-containing very long-chain TAGs through targeted liquid chromatography-mass spectrometry/mass spectrometry (LC-MS/MS) of strains expressing different GPAT genes in the TP03 background. The plot shows the total amount of TAGs containing C22:0 fatty acids compared to the amount of di-behenyl (C22:0-C22:0-X, C22:0-X-C22:0, X-C22:0-C22:0) TAGs. All values are normalized to cell dry biomass.

We can observe that the strains expressing BnGPAT7 and BnGPAT3** can produce significantly higher levels of di-behenyl TAGs while also producing higher total amount of C22:0-containing TAGs compared to the control strain (FIG. 6). Strains expressing McGPAT9 and RsGPAT9 also show significantly higher amount of total C22 TAGs.

Example 4: Expression of Specific DGATs, GPATs and Lipases Leads to Altered TAG Composition in Fungal Cells Increasing the Content of Very Long-Chain Fatty Acids This example demonstrates how expression of specific GPATs, DGATs and lipases in a fungal cell can alter the triacylglycerol (TAG) composition to increase production of TAGs containing very long-chain fatty acids.

As a proof of concept, we focused on combining overexpression of a heterologous DGAT and GPAT together a lipase identified from Example 1. This strategy would promote the formation of position-specific dibehenate TAGs, with the structure behenate:X:behenate (di-behenyl TAGs). All genetic modifications, cultivations, and analysis were performed as described in Example 1.

To validate and quantify the combined effect of the screened GPAT and lipase genes, the most beneficial genes were selected, and new strains were created expressing either the GPAT BnGPAT3** (the AA68-AA434 variant described in Example 3) or in combination with the lipase (YILip2) gene. Plasmids were constructed expressing the GPAT and lipase (p416 CEN.ARS plasmid, with the GPAT under the GAL1 promoter and ENO2 terminator control and the lipase under the TEF1 promoter and CYC1 terminator control). The cloning was done using fusion PCR and yeast homologous recombination based on homologous overhangs. URA3 was used as selection marker.

Figure 7:
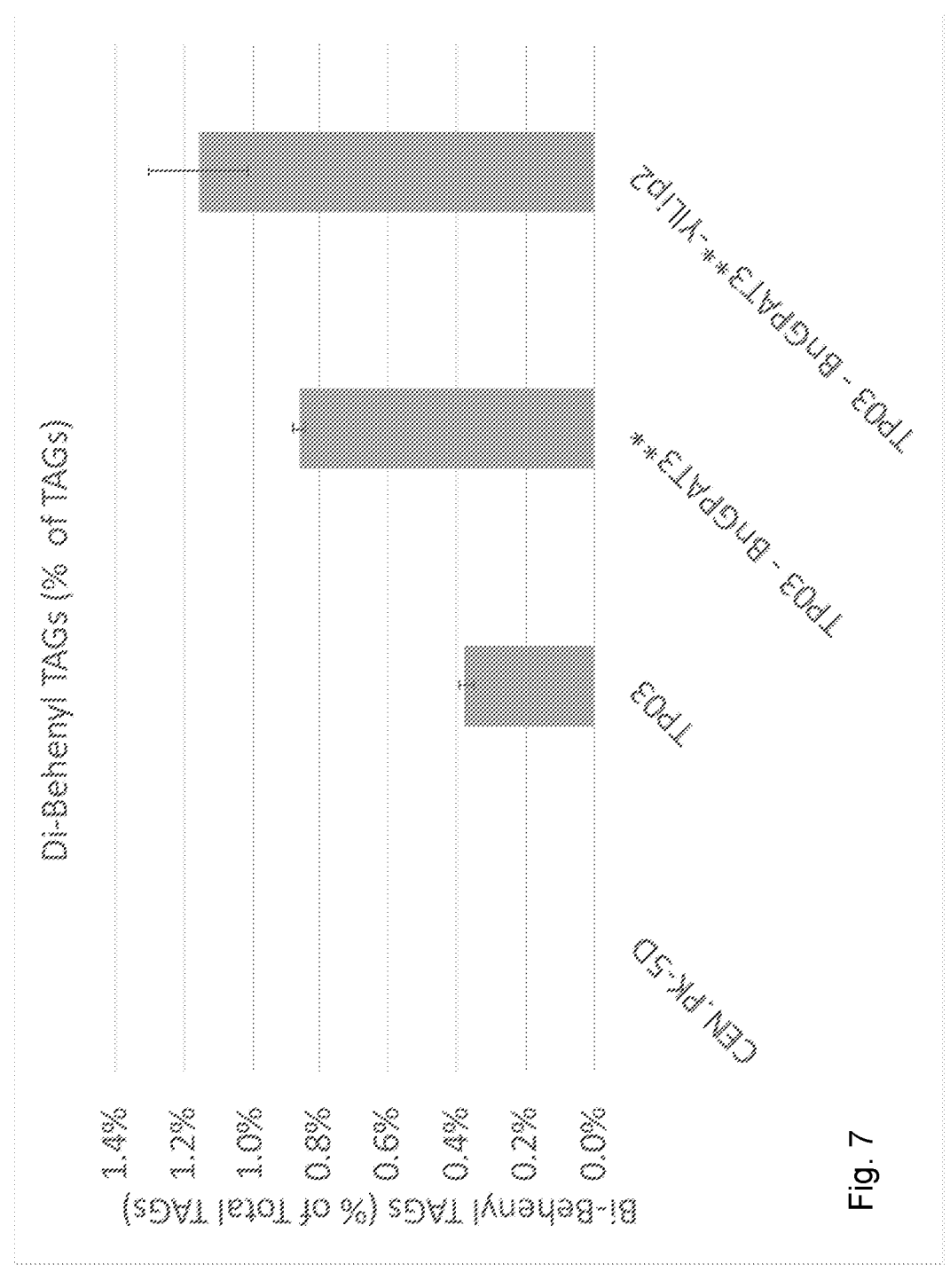
FIG. 7. Quantification of TAGs containing C22:0 chains in different engineered strains. Total amount of TAGs containing two C22:0 acyl-chains, normalized to the total amount of TAGs in each sample.

These plasmids were transformed into TP03 expressing the previously selected TmDGAT1 gene. The resulting strains were cultivated as described in Example 1 above. To enable accurate quantification of different TAG species, samples were quantified using GC/Q-TOF with analytical standards covering different chain lengths and targeting the different expected species. Targeted metabolomics was done selecting specifically TAG species which contain C16, C18, C22 fatty acids. The results show that enrichment of TAGs containing two C22:0 chains is increased up to 3-fold in engineered strains (FIG. 7). The total TAGs were not significantly changed between TP03 and its derived strains.

Example 5: Overexpression of Specific LPATs Leads to Increase in the Saturation Level of Lipids This example demonstrates how overexpression of specific TAG assembly enzymes in a fungal cell leads to increase in the saturation profile of lipids produced by this fungal cell.

In this example, the following three LPATs, *Arabidopsis thaliana* LPAT1 (SEQ ID NO: 20, AtLPAT1), *Bos taumus* AGPAT1 (SEQ ID NO: 16, BtAGPAT1), *Cocos nucifera* probable LPAT (SEQ ID NO: 86, CnLPAAT), and the following two DGATs, *Bos taurus* DGAT2 (SEQ ID NO: 66, BtDGT2), *Tropaeolum majus* DGAT (SEQ ID NO: 10, TmDGAT), were tested.

All enzymes were codon-optimized for expression in yeast. The respective codon-optimized sequences are shown in SEQ ID NO: 171-174, 155. All sequences also included a kozak (AAAACA) sequence before the start codon. All genes were individually cloned into a p416TEF plasmid (Mumberg et al, 1994) under the control of a TEF promoter (pTEF1) and CYC1 terminator.

As background strain, a *Saccharomyces cerevisiae* strain with the genotype MATa SUC2 MAL2-8c his3Δ1 ura3-52 X-2 pHXK1-ACC1**-tCYC1 loxP-KanMX4 was used (Bergenholm et al, 2018). Plasmids containing the codon-optimized LPATs and DGATs, as well as an empty control plasmid, were then individually transformed in the yeast strain using the lithium/acetate method (Gietz and Schiestl, 2007) and selected using URA dropout media containing 6.9 g/L yeast nitrogen base without amino acids (Formedium, Hunstanton, UK), 0.77 g/L complete supplement mixture without uracil (Formedium), 20 g/L glucose and 20 g/L agar.

Cultivation was done in minimal media (composition as described in Example 1, with the addition of 100 mg/L histidine supplementation). Biological duplicates were pre-cultivated as described in Example 1. Subsequently, the pre-culture was diluted in to 6 ml minimal medium in a 50 ml falcon tube to an OD600 of 0.1. Falcon tubes were incubated at 200 rpm and 30° C. for 72 h.

To analyze the fatty acid composition in the strains expressing different TAG assembly genes, fatty acid methyl esters (FAMEs) were prepared. Cell pellets were collected via centrifugation for 5 minutes at 1000 relative centrifugal force (rcf). The samples were then freeze dried overnight. 500 μl 1N NaOH in MeOH were then added to each sample, as well as 20 μl standard (C17 TAG, 1000 μg/ml in hexane). The samples were vortexes for 1 hour, followed by addition of 80 μl of sulfuric acid (49%) and 400 μl hexane. The samples were then vortexed and centrifuged at 11000 rcf for 1 minute. 200 μl of the hexane (upper) layer were then taken and analyzed by GC-MS (Theremo ISQ-LT). Separation of FAMEs was performed on Zebron (ZB-WAX) GC column (30 m×0.25 mm I.D., 0.25-μm film thickness) from Phenomenex. The column temperature was initially set to 80° C. (2 min). The temperature was then ramped up to 160° C. (40° C./min) for 4 min, followed by ramping up to 185° C. (5° C./min) for 4 min, and 200° C. (5° C./min) for 4 min. Finally, the temperature was increased to 260° C. (40° C./min) for 2 min.

Figure 8A:
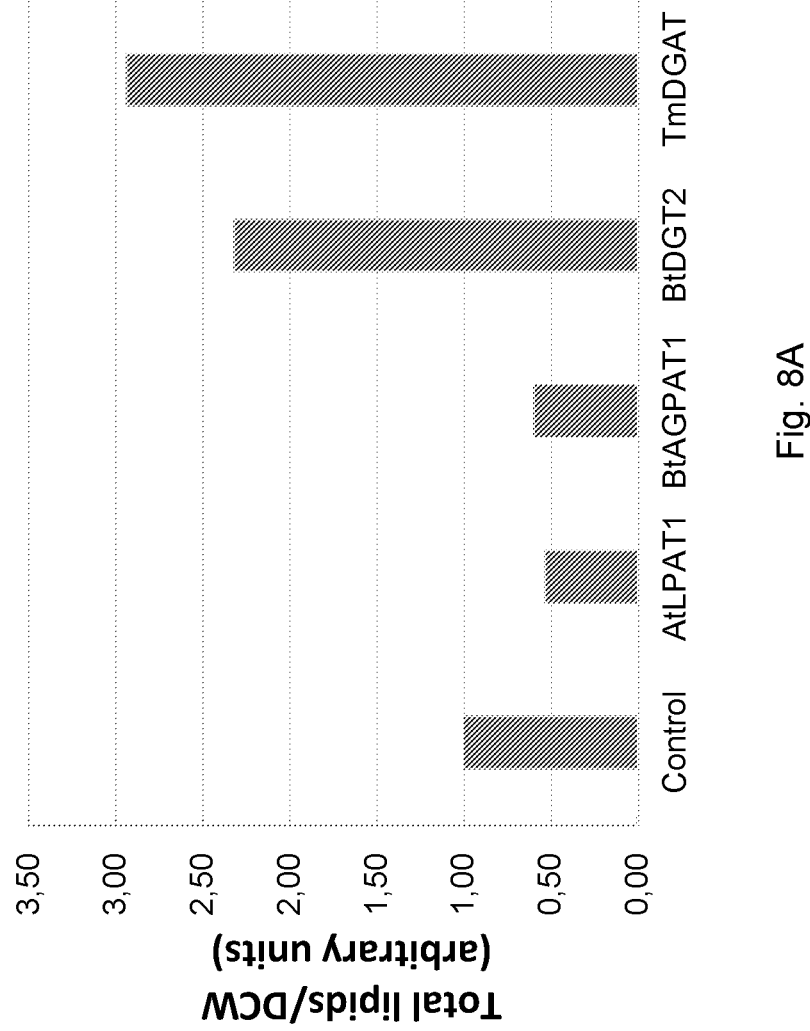
FIG. 8. Effect of heterologous expression of selected LPATs and DGATs on lipid production and composition. (A) lipid levels per dry cell weight, normalized to control, (B) Saturation content per total lipids, normalized to control.
Figure 8B:
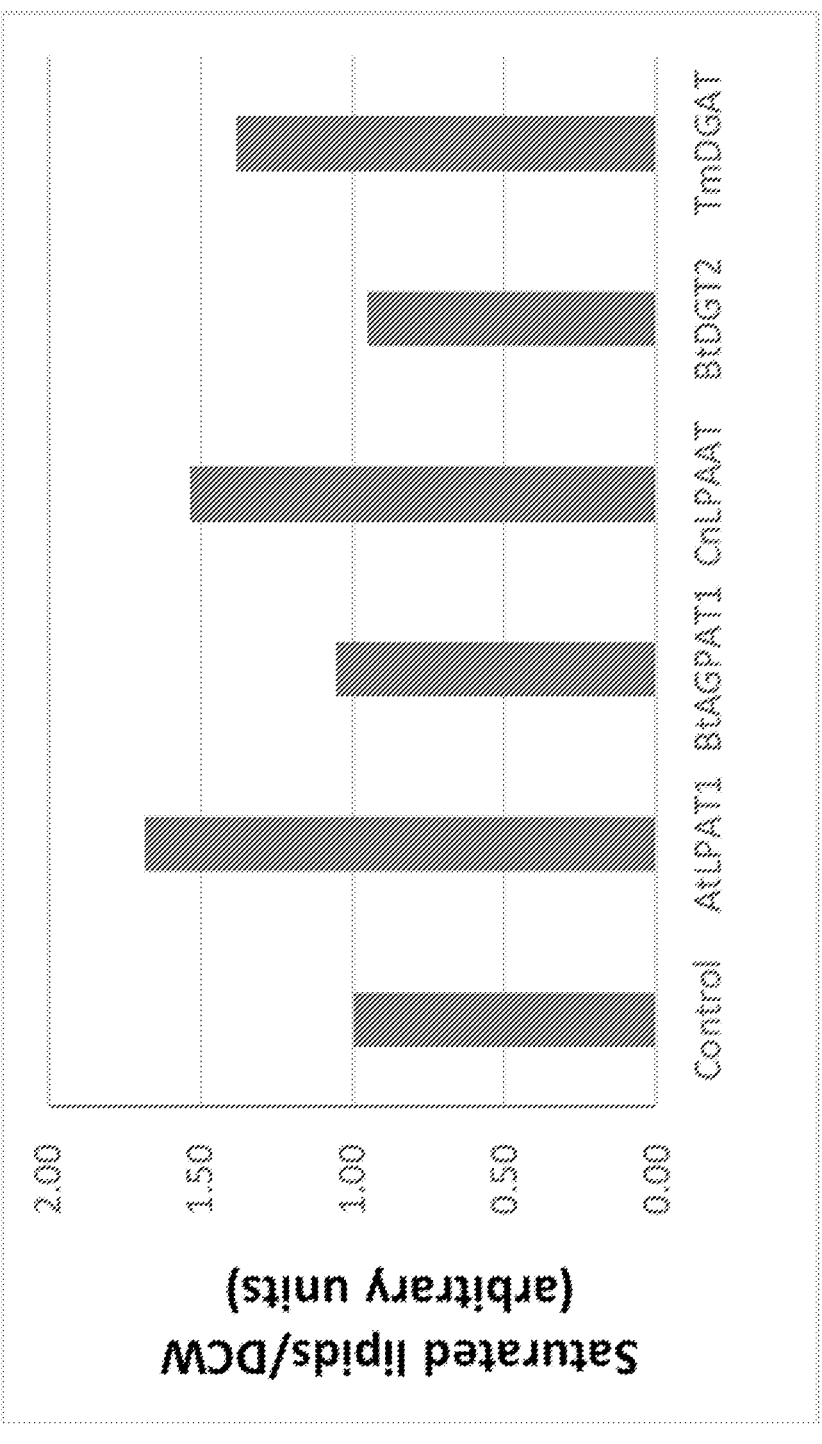

FIGS. 8A and 8B show the lipid profiles of the individual strains. FIG. 8A shows the total lipid amounts of the resulting strains (% lipid per dry cell weight), expressed relative to the control strain, while FIG. 8B shows the % saturation, relative to the control strain. Overexpression of either BtDGT2 or TmDGAT significantly increased lipid production compared to control, suggesting that these enzymes could be useful to overall increase lipid levels. In addition, overexpression of AtLPAT1, BtAGPAT1, CnL-PAAT, or TmDGAT increased % saturation in lipids. This suggests that these enzymes can be used for production of saturated lipids.

Example 6: Replacing Native SLC1 with Specific AGPAT Leads to Increase in the Saturation Level of Lipids This example demonstrates how replacing the native SLC1 gene with a specific AGPAT in a fungal cell leads to increase in the saturation profile of lipids produced by this fungal cell.

In this example, the native SLC1 gene was replaced with an AGPAT from *Bos taurus* AGPAT1 (SEQ ID NO: 16, BtAGPAT1).

The enzyme was codon-optimized for expression in yeast. The respective codon-optimized sequence is shown in SEQ ID NO: 172. All sequences also included a kozak (AAAACA) sequence before the start codon. A cassette for integration of the codon optimized BtAGPAT1 replacing the native SLC1 gene in the genome was constructed via fusion PCR. This cassette included a marker gene KIURA combined with its own promoter and terminator for selection and a terminator region from ENO2 following the BtAGPAT1 gene. The cassette was flanked by homologous regions including part of the SLC1 promoter and terminator to enable replacement of the SLC1 gene. The overall cassette was constructed as follows: pSLC1(45 bp)-BtAGPT1a-tENO2-KIURA-tSLC1(45 bp). Genetic modifications in yeast for integration of expression cassettes were carried out according to standard molecular biology methods as described in (David and Siewers, 2015).

As background strain, th a *Saccharomyces cerevisiae* strain with the genotype MATa SUC2 MAL2-8c his3Δ1 ura3-52 X-2 pHXK1-ACC1**-tCYC1 loxP-KanMX4 was used (Bergenholm et al., 2018). The integration cassette was transformed in the yeast strain using the lithium/acetate method (Gietz and Schiestl, 2007) and selected using URA dropout media containing 6.9 g/L yeast nitrogen base without amino acids (Formedium, Hunstanton, UK), 0.77 g/L complete supplement mixture without uracil (Formedium), 20 g/L glucose and 20 g/L agar.

Cultivation was done in minimal media (composition as described in Example 1, with the addition of histidine/uracil supplementation (100 mg/L). Biological duplicates were pre-cultivated as described in Example 1. Subsequently, the pre-culture was diluted into 6 ml minimal medium in a 50 ml Falcon tube to an OD600 of 0.1. Falcon tubes were incubated at 200 rpm and 30° C. for 72 h.

Lipids were extracted using the Folch method (Folch et al, 1957). As a first step, cell pellets were collected via centrifugation for 5 minutes at 1000 rcf. The samples were then freeze dried overnight. 1 μg internal standard (C17:0-17:1-17:0d5 TAG, 1000 μg/ml in hexane) was added to each sample. To each sample tube, 1 ml of chloroform:methanol (2:1, v/v) was added and mixed for 20 minutes. 267 μl of 0.73% NaCl solution was added and mixed for 1 minute and then centrifuged at 2500 rpm for 8 minutes. The methanol water-phase was removed and the chloroform phase was analyzed via lipidomics as described in Example 1. For acquiring the data, the mass spectrometer Xevo G2-XS QToF from Waters was used and for data analysis the MSdial software was used.

Figure 9A:
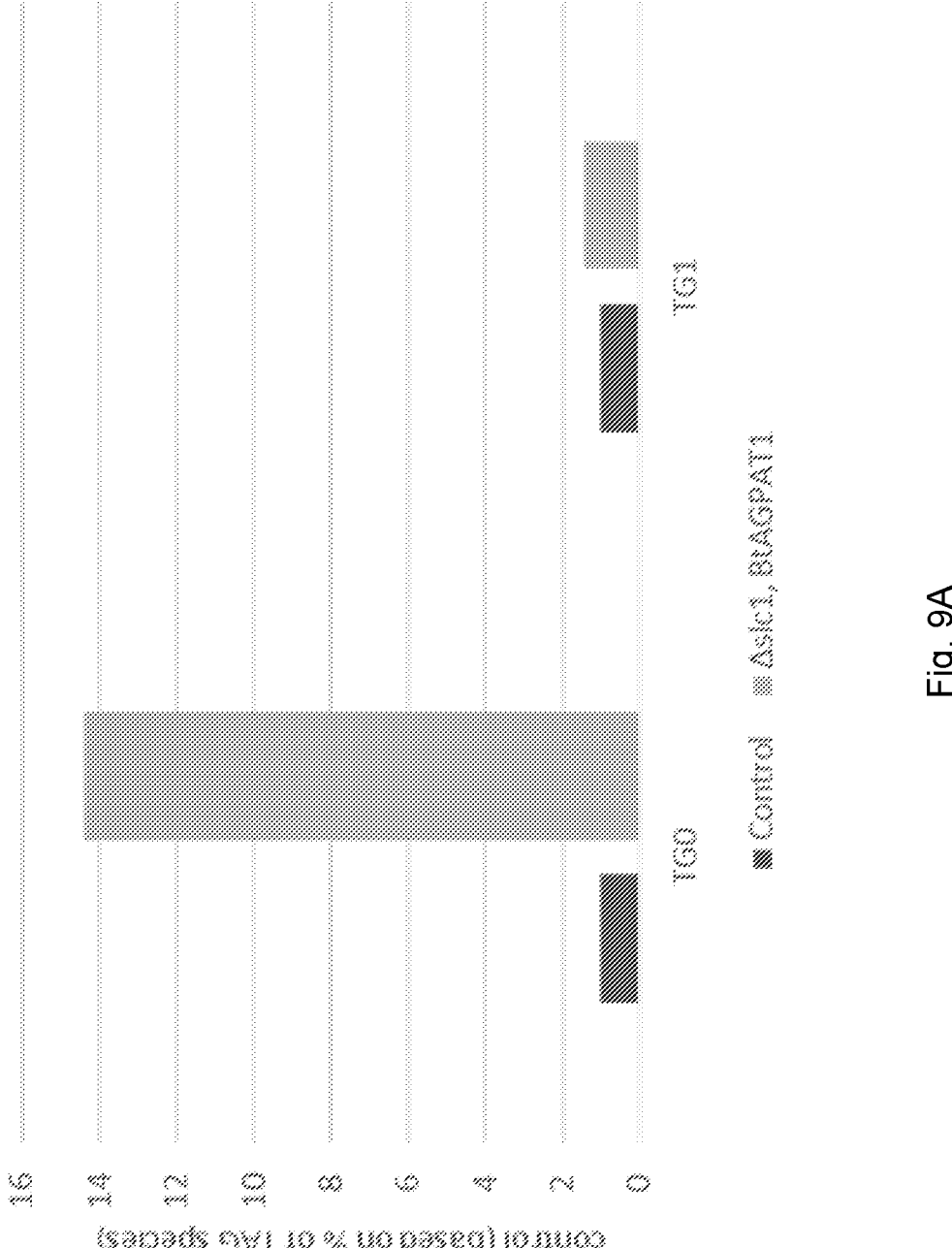
FIG. 9. (A) shows the lipidomic analysis of overall TAG species (% of total TAGs) in relation to the respective control strain. The definitions are as follows: TG0=no unsaturated fatty acids in respective TAGs, TG1=one unsaturated fatty acid in respective TAGs, TG2=two unsaturated fatty acids in respective TAGs, TG3=three unsaturated fatty acids in respective TAGs. (B) shows changes in some of specific TAG species compared to the control strain.
Figure 9A:
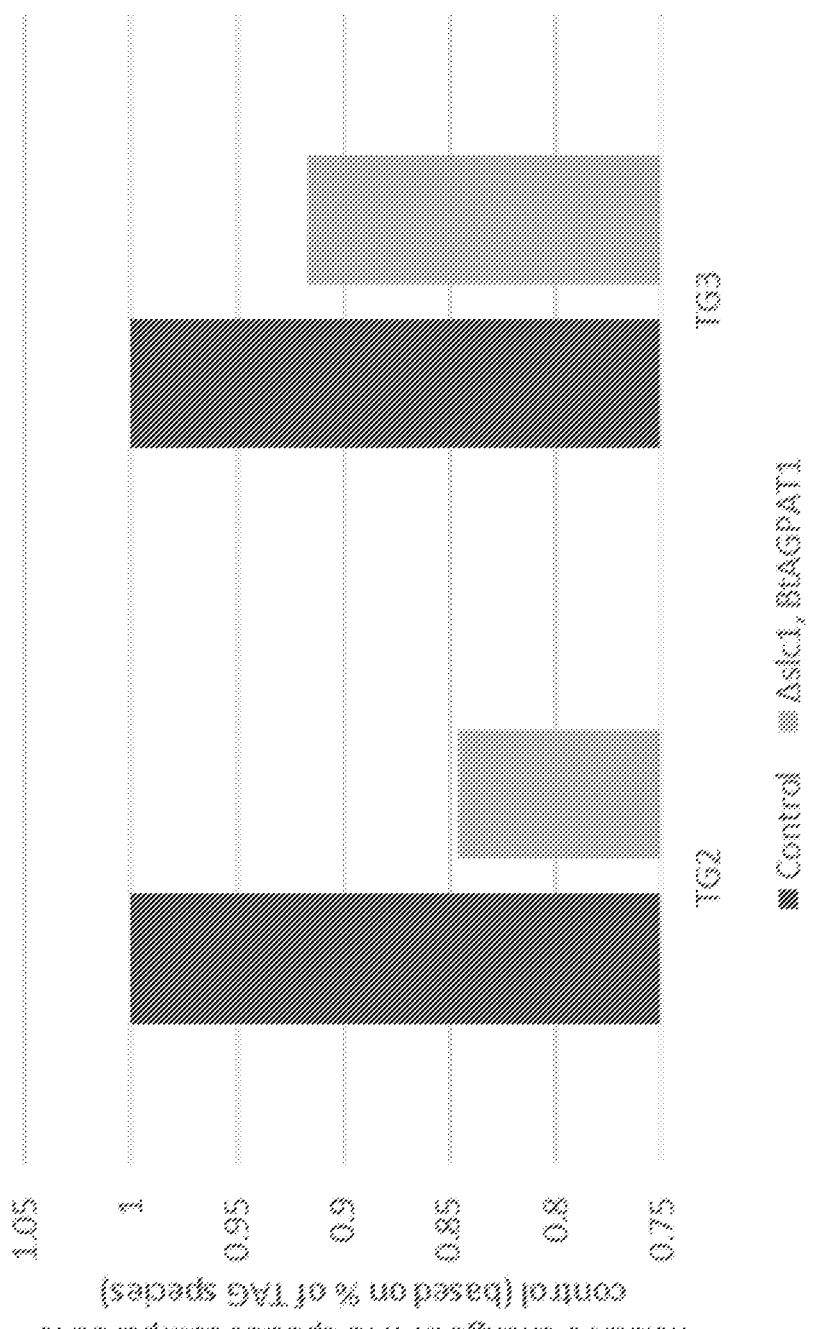
Figure 9B:
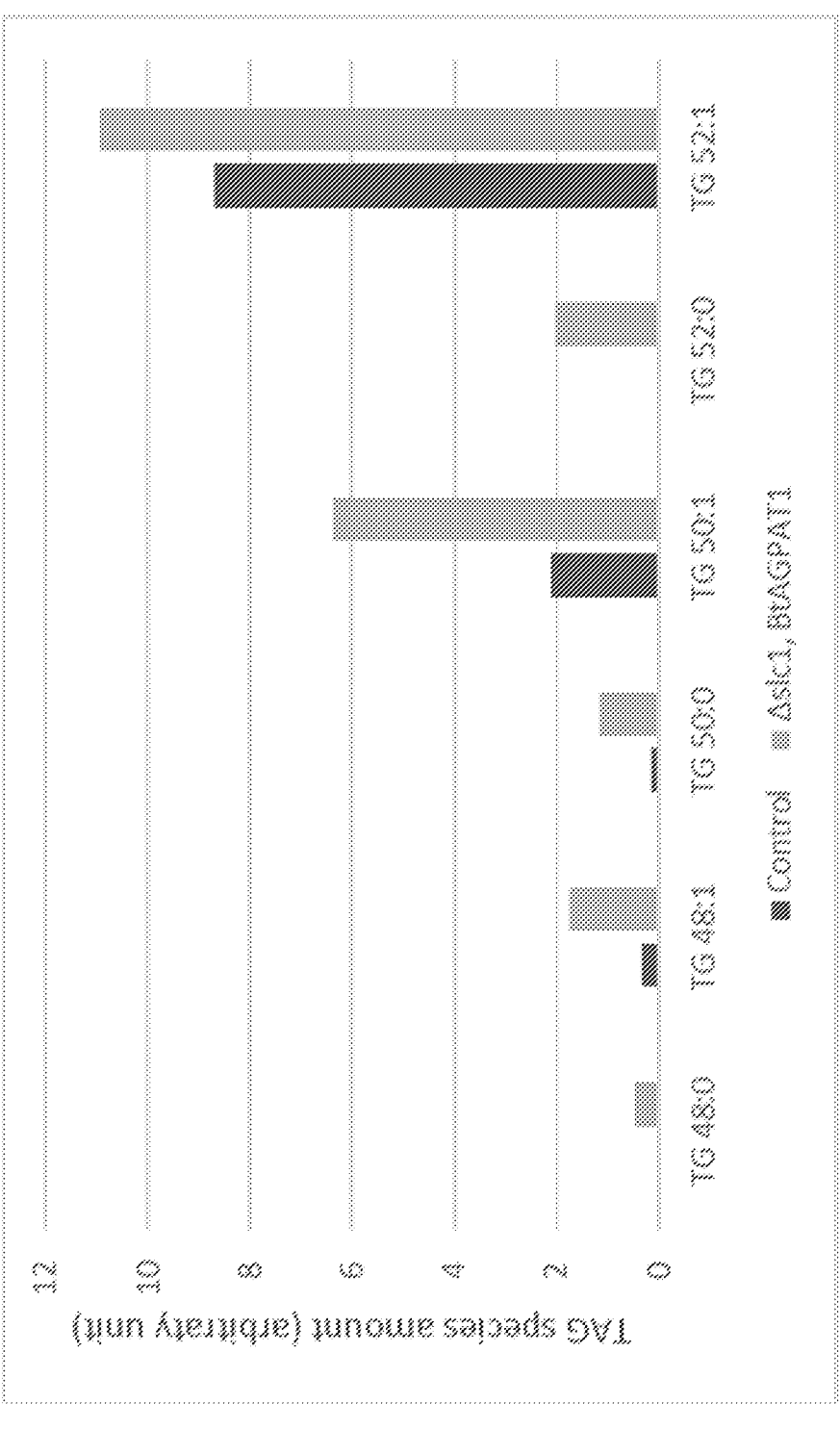

FIGS. 9A and 9B show the lipidomic analysis of overall TAG species (% of total TAGs) in relation to respective control strain. FIG. 9A shows changes in some of the TAG species in respective strains.

Replacing the native SLC1 with BtAGPAT1 significantly increased TAG species with no (TG0) or one (TG1) unsaturated fatty acids (FIG. 9A). At the same time, the replacement of the natice SLC1 with BtAGPAT1 led to a decrease in TAG species with two (TG2) or three unsaturated fatty acids (TG3) (FIG. 9A). The results indicated that this enzyme (BtAGPAT1) is more active on saturated fatty acids than unsaturated fatty acids. This is also supported by the increase in certain TAG species (TAG 48:0, 48:1, 50:0, 50:1, 52:0 and 52:1) (FIG. 9B).

Example 7: Expression of Specific DGATs, GPATs, LPATs and Lipases Leads to Altered TAG Composition in Fungal Cells with Animal Meat-Like Composition of TAGs This example demonstrates creation of fungal cells with a meat-like TAG composition. This includes increased production of TAG species abundant in animal (e.g. beef) meat fat. It is also desired that saturated fatty acids will comprise approx. 30-40% of the fat TAG composition.

As background yeast strain the strain CEN.PK113-5D (MATa ura3-52 TRP1 LEU2 HIS3) was used. Codon-optimized synthetic genes for *S. cerevisiae* coding for heterologous DGATs, GPATs, LPATs and lipases were individually cloned into a p416GAL plasmid under the control of a GAL1 promoter using XbaI/XhoI and transformed into the background strain as described in Example 1. Codon optimization of the genes for expression in *S. cerevisiae* was done using JCAT (http://www.jcat.de/), with the algorithm set to exclude XbaI, XhoI, BamHI, NheI, SpeI, sac, AsiSI, NotI sites. Sequences also include a kozak sequence (AAAAACA) ahead of the start site and were flanked by XbaI/NotI.

The lipase that were evaluated included *Diutina rugosa* LIP1 (SEQ ID NO: 39), *Streptomyces rimosus* CP984_RS32550 (SEQ ID NO: 40), *Geotrichum candidum* LIP1 (SEQ ID NO: 41), *Geotrichum candidum* LIP2 (SEQ ID NO: 42), *Streptomyces coelicolor* LIP1 (SEQ ID NO: 43), *Amycolatopsis mediterranei* AMED_3680 (SEQ ID NO: 45), *Penaeus vannamei* C7M84_014708 (SEQ ID NO: 48), *Solanumlycopersicum* LeLID1 (SEQ ID NO: 50), *Pseudozyma aphidis* LIPA (SEQ ID NO: 51).

The GPATs that were evaluated included *Bos taurus* GPAT4 isoform X1 (SEQ ID NO: 52), *Bos taurus* GPAT4 isoform X2 (SEQ ID NO: 53), *Bos taurus* GPAT2 (SEQ ID NO: 54), *Bos taurus* GPAT3 isoform X1 (SEQ ID NO: 55), *Bos taurus* GPAT3 isoform X2 (SEQ ID NO: 56), *Bos taurus* GPAT3 isoform X3 (SEQ ID NO: 57), *Bos taurus* GPAT3 isoform X4 (SEQ ID NO: 58), *Mus musculus* GPAT4 isoform X1 (SEQ ID NO: 59), *Homo sapiens* GPAM isoform X1 (SEQ ID NO: 60), *Cucurbita moschata* ATS1;2 (SEQ ID NO: 61), *Mus musculus* GPAT2 (SEQ ID NO: 63).

The LPATs that were evaluated included *Bos taurus* AGPAT4 (SEQ ID NO: 13, 14, or 15), *Bos taurus* AGPAT1 (SEQ ID NO: 16), *Bos taurus* AGPAT2 (SEQ ID NO: 17), *Bos taurus* AGPAT3 (SEQ ID NO: 18), *Bos taurus* AGPAT5 (SEQ ID NO: 19), *Arabidopsis thaliana* LPAT1 (SEQ ID NO: 20), *Brassica napus* LPAT1 (SEQ ID NO: 24), *Mycolicibacterium smegmatis* ERS451418_00313 (SEQ ID NO: 28), *Mycolicibacterium smegmatis* WP_058127236.1 (SEQ ID NO: 29), *Mycolicibacterium smegmatis* ERS451418_06226 (SEQ ID NO: 30), *Mycolicibacterium smegmatis* ERS451418_02370 (SEQ ID NO: 31), *Mycolicibacterium smegmatis* ERS451418_05575 (SEQ ID NO: 32), *Mycolicibacterium smegmatis* ERS451418_04128 (SEQ ID NO: 33), *Mycolicibacterium smegmatis* ERS451418_06227 (SEQ ID NO: 34), *Mycolicibacterium smegmatis* BIN_B_00519 (SEQ ID NO: 35), *Mycolicibacterium smegmatis* D806_035910 (SEQ ID NO: 36), *Mycolicibacterium smegmatis* BIN_B_03706 (SEQ ID NO: 37), *Mycolicibacterium smegmatis* D806_003290 (SEQ ID NO: 38).

The DGATs that were evaluated included *Bos taurus* DGAT1 isoform X1 (SEQ ID NO: 64), *Bos taurus* DGAT1 isoform X2 (SEQ ID NO: 65), *Bos taurus* DGAT2 (SEQ ID NO: 66), *Bos taurus* DGAT2L6 (SEQ ID NO: 67), *Homo sapiens* DGAT2 (SEQ ID NO: 69), *Arachis hypogaea* DGAT3 (SEQ ID NO: 70), *Thraustochytrium aureum* DGAT2 (SEQ ID NO: 72).

All genetic modifications, cultivations, and TAG analysis were performed as described in Example 1.

In addition to evaluation in CEN.PK113-5D background, the GPATs were evaluated in CEN.PK113-5D sctl, CEN.PK113-5D gpt2, and CEN.PK113-5D sctlgpt2 background strains containing deletions in endogenous GPATs.

In addition to evaluation in CEN.PK113-5D background, the LPATs were evaluated in CEN.PK113-5D slc1, CEN.PK113-5D ale1, and CEN.PK113-5D slc1ale1 background strains containing deletions in endogenous LPATs.

In addition to evaluation in CEN.PK113-5D background, the DGATs were evaluated in CEN.PK113-5D dga1 background strain containing deletion in the endogenous DGAT.

After the initial evaluation, specific combinations of DGATs, GPATs, LPATs and lipases were evaluated.

Example 8: Expression of Specific DGATs, GPATs, LPATs and Lipases Leads to Altered TAG Composition in Fungal Cells with Dairy Like Composition of TAGs This example demonstrates creation of fungal cells with a dairy-like TAG composition. This includes increased production of TAG species abundant in animal dairy fat.

As background yeast strain the strain CEN.PK113-5D (MATa ura3-52 TRP1 LEU2 HIS3) was used.

Codon-optimized synthetic genes for *S. cerevisiae* coding for heterologous DGATs, GPATs, LPATs, lipases, and oxidases were individually cloned into a p416GAL plasmid under the control of a GAL1 promoter and transformed into the background strain. All genes were codon-optimized and cloned into p416GAL as described in Example 5. Other genetic modifications, cultivations, and TAG analysis were performed as described in Example 1.

The lipases evaluated included *Yarrowia deformans* Lip1 (SEQ ID NO: 147, *Amycolatopsis mediterranei* U32 lipase AMED_7492 (SEQ ID NO: 105), *Burkholderia cepacia* Alkaline lipase A9QXC9 (SEQ ID NO: 106), *Psychrobacter* sp. 7195 lipA1 (SEQ ID NO: 107), *Geobacillus stearothermophilus* Q9L6D3 (SEQ ID NO: 109), *Serratia marcescens* esf (SEQ ID NO: 110), *Geotrichum candidum* Q0MVP3 (SEQ ID NO: 111), *Fusarium vanettenii* 77-13-4 encoded by NECHADRAFT_34836 (SEQ ID NO: 112), *Bacillus amyloliquefaciens* lip4 (SEQ ID NO: 113), *Geotrichum candidum* LIP1 (SEQ ID NO: 41), *Diutina rugosa* LIP1 (SEQ ID NO: 39), *Diutina rugosa* LIP2 (SEQ ID NO: 116).

The GPATs evaluated included *Bos taurus* GPAT4 isoform X1 (SEQ ID NO: 52), *Bos taurus* GPAT4 isoform X2 (SEQ ID NO: 53), *Cocos nucifera* GPAT9 (SEQ ID NO: 80), *Bos taurus* GPAM (SEQ ID NO: 81). the LPATs evaluated included *Bos taurus* AGPAT3 (SEQ ID NO: 18), *Bos taurus* AGPAT5 (SEQ ID NO: 19), *Cocos nucifera* probable LPAT (SEQ ID NO: 86), *Cuphea viscosissima* LPAT2 (SEQ ID NO: 87), *Cuphea avigera* var. *pulcherrima* LPAT2a (SEQ ID NO: 88), *Cuphea avigera* var. *pulcherrima* LPAT1B (SEQ ID NO: 89). the DGATs evaluated included *Cuphea avigera* var. *pulcherrima* DGAT1 (SEQ ID NO: 95), *Elaeis guineensis* DGAT1-2 (SEQ ID NO: 96), *Bos taurus* DGAT1 (SEQ ID NO: 97), *Capra hircus* DGAT1 isoform X2 (SEQ ID NO: 98), *Cocos nucifera* DGAT1 (SEQ ID NO: 99).

The acyl-CoA oxidases evaluated included *Arabidopsis thaliana* ACX1 (SEQ ID NO: 117-118), *Arabidopsis thaliana* ACX2 (SEQ ID NO: 119-120), *Arabidopsis thaliana* ACX3 (SEQ ID NO: 121), *Yarrowia lipolytica* POX2 (SEQ ID NO: 122), *Yarrowia lipolytica* POX3 (SEQ ID NO: 123), *Glycine max* ACX (SEQ ID NO: 125), *Paenarthrobacter ureafaciens* aco (SEQ ID NO: 126), *Rattus norvegicus* ACOX1 (SEQ ID NO: 127), *Rattus rattus* ACOX1 isoform X2 (SEQ ID NO: 128), *Chlamydomonas reinhardtii* CHLRE_05g232002v5 (SEQ ID NO: 129), *Prunus persica* ACX1 (SEQ ID NO: 130), *Cocos nucifera* putative ACX (SEQ ID NO: 144-145).

In addition to evaluation in CEN.PK113-5D background, the acyl-CoA oxidases were evaluated in CEN.PK113-5D pox1 background strain containing deletions in endogenous acyl-CoA oxidase.

Specific lipase, GPAT, LPAT, DGAT and acyl-CoA oxidase genes were selected according to their function to increase dairy-like TAG compositions. Specific combinations of DGATs, GPATs, LPATs and lipases were tested through expression on plasmids.

REFERENCES

Almagro Armenteros J J, Tsirigos K D, Sønderby C K, Petersen T N, Winther O, Brunak S, von Heijne G, Nielsen H. SignalP 5.0 improves signal peptide predictions using deep neural networks. Nat Biotechnol. 2019 April; 37(4):420-423. doi: 10.1038/s41587-019-0036-z.
Bergenholm D, Gossing M, Wei Y, Siewers V, Nielsen J. Modulation of saturation and chain length of fatty acids in Saccharomyces cerevisiae for production of cocoa butter-like lipids. Biotechnol Bioeng. 2018 April; 115(4):932-942. doi: 10.1002/bit.26518. Epub 2018 Jan. 24.
David F, Siewers V. Advances in yeast genome engineering. FEMS Yeast Res. 2015 February; 15(1):1-14. doi: 10.1111/1567-1364.12200. Epub 2015 Jan. 14.
Gietz R D, Schiestl R H. High-efficiency yeast transformation using the LiAc/SS carrier DNA/PEG method. Nat Protoc. 2007; 2: 31-34. doi:10.1038/nprot.2007.13 Folch J, Lees M, Sloane Stanley G H. A simple method for the isolation and purification of total lipides from animal tissues. J Biol Chem. 1957 May; 226(1):497-509.
Frank K, Sippl M J. High-performance signal peptide prediction based on sequence alignment techniques. Bioinformatics. 2008; 24: 2172-2176. doi:10.1093/bioinformatics/btn422
Khoomrung S, Chumnanpuen P, Jansa-ard S, Nookaew I, Nielsen J. Fast and accurate preparation fatty acid methyl esters by microwave-assisted derivatization in the yeast Saccharomyces cerevisiae. Appl Microbiol Biotechnol. 2012; 94: 1637-1646. doi:10.1007/s00253-012-4125-x
Mumberg D, Müller R, Funk M. Regulatable promoters of Saccharomyces cerevisiae: comparison of transcriptional activity and their use for heterologous expression. Nucleic Acids Res. 1994 Dec. 25; 22(25):5767-8. doi: 10.1093/nar/22.25.5767.
Solis-Escalante D, Kuijpers N G, Bongaerts N, Bolat I, Bosman L, Pronk J T, Daran J M, Daran-Lapujade P. amdSYM, a new dominant recyclable marker cassette for Saccharomyces cerevisiae. FEMS Yeast Res. 2013 February; 13(1):126-39. doi: 10.1111/1567-1364.12024.
Verduyn C, Postma E, Scheffers W A, Van Dijken J P. Effect of benzoic acid on metabolic fluxes in yeasts: a continuous-culture study on the regulation of respiration and alcoholic fermentation. Yeast. 1992; 8: 501-517.
Yu T, Zhou Y J, Wenning L, Liu Q, Krivoruchko A, Siewers V, Nielsen J, David F. Metabolic engineering of Saccharomyces cerevisiae for production of very long chain fatty acid-derived chemicals. Nat Commun. 2017 May 26; 8:15587. doi: 10.1038/ncomms15587.

SEQUENCE LISTING (174 sequences)

SEQ ID NO: 1 - protein, 566 aa, Brassica napus
MESSTTTSYSVVSELEGTLLKTPKPFAYFMLMAFEASGLIRYTLLLFLWPIIALLDVLGYRNGSLKLMIFVATAGLRESEIESVARAVLPKFYMDDISMDAWRVFGSCEKRVVVTRMPRVMVERFAKDHLRADEVIGTEIIINRFGYATGFIQESDVDRSIFNSVANLFEDRRPQLGLGRPIISGSQTFLSLCEEQVHAPVPSNYNVQRLHVQLLPVIFHDGRLVKLPTPATALLILLWIPFGIVLAVVRLFIGSMLPLWAIPYVSRIFNIRFIVKGKPPAPASAGNQGVLFVCTHRTVMDPVILSYVLGRSIPAVTYSVSRLSEILSPIPTFRLTRVRDVDAEIIKKELSNGDLVVYPEGTTCREPFLLRFSALFAELTDKIVPVAMNYRVGFFHATTARGWKAFDPIFFFMNPRPVYEVTFLNQLEVEATCSSGKSPYDVANYVQRILAATLGFECTNFTRKDKYRVLAGNDGTVSYSSFLDQFKKTARLFFVLAVTDDASLIEVPVRRKNLPINVIGVATSSISGEANCSFHSYVWQINPGTEVELGDTQLQYFSFHHPELGT

SEQ ID NO: 2 - protein, 456 aa, Brassica napus
MLVAFEAGGVIRSFILFILYPLITLMLSHEMGVKVMVMVSFFGIKKDGFRAGGAVLPKHFLEDVGLEMFKVLRKGGKRIVVSYDLPQVMIEGFLRDYLEVEVVVGREMKVVGGYYLGIMEDKTKHDLVFDELVRKERLNTGRVIGITSYNTSLHRYLFSQFCQEIYFVKRSDKRTWQTLPKSQYPKPLIFHDGRLAIRPTLMNTLALFMWGPFAVLAAAARLFVSLCIPYTLSIPILSFFGCRLTVKIDDVSSQKLNSSERKGCLFACNHRTLLDPLYVGFALKKKNIKTVTYSLSRVSEILAPIKTVRLTRDRVSDGQAMKKLLAEGDLVVCPEGTTCREPYLLRFSPLFAEISDVIVPVAVTSPATFFYGTTASGLKAFDPLFFLMDPYPTYTVQFLDPVPGVTCQDPEGKLKFEVANHVQSAIGKALDFECTYLTRKDKYLILAGNNGVVKKN

SEQ ID NO: 3 - protein, 460 aa, Raphidocelis subcapitata
MSVTEAAPNGVARTTSAQFHSFLPGLTMPAGHAAAAADDLAELTDREVEQAYVAAEEERLLGHSHSLLTDMLSIEGVLADAAAAVVDDSFNKCFTSTPSDPWNWNLYLFPMWLLGVVFRYVILFPLRLFGLIACFAAFFLMFFPVKALWPPGRTKLAVEQRLIRFMCGGFVLSWTGVIRFHGPRPIRGAGRVWVANHTSMIDYIILSSYSAFAVIMQLHSGWVGFLQTQCLDSLGCLWFNRTEVKDRHLVAQRMRQHVHADATPLLIFPEGTCVNNEYCVMFKRGAFEMDAVVHPIAIKYNKIFVDAFWNSRRQSFTQHLLKLMTSWAVVADVYFLEPQRRREGEGTDGFASRVQEMIARKANLRVVPWDGYLKYYNLGEKHPGLIEKRRRVYADVLRKYLRPSEAGGGAGAGGARPGSGGGGRAAGVGRVEEGEEEGEQQQQQQQRPNGAASPETKKVN

SEQ ID NO: 4 - protein, 426 aa, Micractinium conductrix
MSASVRFQERQADGNGALQRTTSGLGYGLRSLKNKTFSRGDLTTFEELHKGPNSAEMQRAIDEAVVTAEREACAALGAGNVVRDVLDIASPLNDAAAAIVDDSFLRCFKSCLDDPWNWNAYLFPMWVLGVAVRNLLLFPLRLIMLLLGALIFIAGYALVGLVLKGQRLKRAERWLVQFLCQMFVVSWTGVIKYHGPRPVPQAGRVWVANHSSMIDFAVLGAYSPFAAIMQLHPGWVGVLQKRYLSSLGCLWFNRTQAQDRTLVARRMKEHVHSADSTPLLIFPEGTCVNNEYCVMFKRGAFDLDATVCPIAIKYNKIFVDAFWNSKCQSFSAHLVKLMRSWALVCDVYFLEPQTRRTGETSQQFAERVQRMIADKARLRVAPWDGYLKYYNLGEKHPDLIEKQRRVFSDAIKQHADPASGGERRRG

SEQ ID NO: 5 - protein, 503 aa, Arabidopsis thaliana
MSPAKKSRSFPPISECKSREYDSIAADLDGTLLLSRSSFPYFMLVAIEAGSLFRGLILLLSLPIVIIAYLFVSESLGIQILIFISFAGIKIKNIELVSRAVLTRFYAADVRKDSFEVFDKCKKRKVVVTANPIVMVEPFVKDYLGGDKVLGTEIEVNPKTMKATGFVKKPGVLVGDLKRLAILKEFGDDSPDLGLGDRTSDHDFMSICKEGYMVHETKSATTVPIESLKNRIIFHDGRLVQRPTPLNALIIYLWLPFGFMLSVFRVYFNLPLPERFVRYTYEILGIHLTIRGHRPPPPSPGKPGNLYVLNHRTALDPIIIAIALGRKITCVTYSVSRLSLMLSPIPAVALTRDRVADAARMRQLLEKGDLVICPEGTTCREPYLLRFSALFAELSDRIVPVAMNCKQGMFNGTTVRGVKFWDPYFFFMNPRPSYEATFLDRLPEEMTVNGGGKTPFEVANYVQKVIGGVLGFECTELTRKDKYLLLGGNDGKVESINKTKSME

SEQ ID NO: 6 - protein, 371 aa, Brassica napus
MSSGAGKLVTSRSELNIEDYLPSGSSIEEPRGKLRLLDLIDISPTLTEAAGAIIDDSFTRCFKSNPPEPWNWNIYLFPLWCFGVVVRYCILFPLRCLTLAFGWFIFLSTFIPVHSLLKGQDKLRKNIERVLVEMICSFFVGSWTGVVKYHGPRPSIRPKQVYVANHTSMIDFIVLEQMTAFAVIMQKHPGWVGLLQSTILESVGCIWFNRSEAKDREIVARKLRDHVQGADNNPLLIFPEGTCVNNNYTVMFKKGAFELGCTVCPIAIKYNKIFVDAFWNSRKQSFTMHLLQLMTSWAVVCEVWYLEPQTIRPGETAIEFAERVRDMISLRAGLKKVPWDGYLKYSRPSSKHSERKQQSFAESLLARLEEK

SEQ ID NO: 7 - protein, 502 aa, Brassica napus
MAVLDSGGVAVPTENGVADLDRLHRRKSRSDSSNGLLPDTSPSDDVGAAAAERDRVDSAAEEEAQGTANLAGGDAETRESAGGDVRFTYRPSVPAHRRTRESPLSSDAIFKQSHAGLFNLCVVVLVAVNSRLIIENLMKYGWLIRTDFWFSSTSLRDWPLFMCCLSLSVFPLAAFTVEKMVLQRFISEPVAIILHVIITLTEVLYPVYVTLRCDSAFLSGVTLMLLTCIVWLKLVSYAHTSYDIRTLANSADKVDPEISYHVSLKSLAYFMVAPTLCYQPSYPRSPCIRKGWVARQFAKLVIFTGLMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHVYFPCLRIKIPKVPAIIIAFLVSAVFHELCIAVPCRLFNLWAFMGIMFQVPLVFITNFLQERFGSMVGNMIFWFSFCIFGQPMCVLLYYHDLMNRKGSMS

SEQ ID NO: 8 - protein, 510 aa, Brassica napus
MAVLDSGGVAVPTENGVADLDRLHRRKSRSDSSNGLISDTSPSDDVGAAAAEDARDRVDSAVEEEAQGTANLAGGDTETRESGGRGGGGNGDVRFTYRPSVPAHRRTRESPLSSDAIFKQSHAGLFNLCVVVLVAVNSRLIIENLMKYGWLIRTDFWFSSTSLRDWPLFMCCLSLSIFPLAAFTVEKMVLQRFISEPVAIILHVIITLTEVLYPVYVTLRCDSAFLSGVTLMLLTCIVWLKLVSYAHTSYDIRTLANSADKVDPEISYHVSLKSLAYFMVAPTLCYQPSYPRSPCIRKGWVARQFAKLVIFTGLMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHVYFPCLRIKIPKVPAIIIAFLVSAVFHELCIAVPCRLFNLWAFMGIMFQVPLVFITNFLQERFGSMVGNMIFWFSFCIFGQPMCVLLYYHDLMNRKGSMS

SEQ ID NO: 9 - protein, 504 aa, Brassica napus
METLDSGGVTMPTENGGADLDTLRHRKPRSDSSNGLLPDSVTVSDADVRDRVDSAVEDTQGKANLAGENEIRESGGGGGEAGGNVDVRYTYRPSVPAHRRVRESPLSSDAIFKQSHAGLFNLCVVVLVAVNSRLIIENLMKYGWLIRTDFWFSSTSLRDWPLFMCCLSLSIFPLAAFTVEKLVLQKCISEPVVIFLHVIITMTEVLYPVYVTLRCDSAFLSGVTLMLLTCIVWLKLVSYAHTNYDIRTLANSSDKANPEVSYYVSLKSLAYFMLAPTLCYQPSYPRSPCIRKGWVARQFAKLIIFTGFMGFIIEQYINPIVRNSKHPLKGDLLYGIERVLKLSVPNLYVWLCMFYCFFHLWLNILAELLCFGDREFYKDWWNAKSVGDYWRMWNMPVHKWMVRHVYFPCLRRNIPKVPAIILAFLVSAVFHELCIAVPCRLFKLWAFLGIMFQVPLVFITNYLQERFGSMVGNMIFWFTFCIFGQPMCVLLYYHDLMNRKGKMS

SEQ ID NO: 10 - protein, 518 aa, Tropaeolum majus
MAVAESSQNTTTMSGHGDSDLNNFRRRKPSSSVIEPSSSGFTSTNGVPATGHVAENRDQDRVGAMENATGSVNLIGNGGGVVIGNEEKQVGETDIRFTYRPSFPAHRRVRESPLSSDAIFKQSHAGLFNLCIVVLIAVNSRLIIENLMKYGWLIDTGFWFSSRSLGDWSIFMCCLTLPIFPLAAFIVEKLVQRNHISELVAVLLHVIVSTAAVLYPVIVILTCDSVYMSGVVLMLFGCIMWLKLVSYAHTSSDIRTLAKSGYKGDAHPNSTIVSCSYDVSLKSLAYFMVAPTLCYQPSYPRSSCIRKGWVVRQFVKLIVFIGLMGFIIEQYINPIVRNSKHPLKGDFLYAIERVLKLSVPNLYVWLCMFYSFFHLWLNILAELLRFGDREFYKDWWNAKTVAEYWKMWNMPVHRWMVRHLYFPCLRNGIPKEGAIIIAFLVSGAFHELCIAVPCHVFKLWAFIGIMFQVPLVLITNYLQEKFSNSMVGNMIFWFIFCILGQPMCVLLYYHDLINLKEK

SEQ ID NO: 11 - protein, 465 aa, Homo sapiens
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 12 - protein, 308 aa, Yarrowia lipolytica
MAVLQKRVYTSTETSHIDQESYNFFEKYARLANIGYCVGPGTKIFKPFNCGLQCAHFPNVELIEEFHDPRLIFDVSGYLAVDHASKQIYLVIRGTHSLEDVITDIRIMQAPLTNFDLAANISSTATCDDCLVHNGFIQSYNNTYNQIGPKLDSVIEQYPDYQIAVTGHSLGGAAALLFGINLKVNGHDPLVVTLGQPIVGNAGFANWVDKLFFGQENPDVSKVSKDRKLYRITHRGDIVPQVPFWDGYQHCSGEVFIDWPLIHPPLSNVVMCQGQSNKQCSAGNTLLQQVNVIGNHLQYFVTEGVCGI

SEQ ID NO: 13 - protein, 417 aa, Bos taurus
MSFPHRVPVRGEFLSPSLPPRWPCSAVGVRCLGEEHDPGMDLVALLKSHFLCHLIFCYVFIVSGLIINTIQLCTLLLWPVNKQLFRKINCRLSYCVSSQLVMLLEWWSGTECVIYTDPRAYPKYGKENAIVVLNHKFEIDFLCGWSLAERFGVLGGSKVLAKKELAYVPIIGWMWYFTEMVFCTRKWEQDRKTVSESLLHLRDYPEKYFFLIHCEGTRFTEKKHQISMQVAQAKGLPSLKHHLLPRTKGFAVTVRSLRNVVSAVYDCTLNFRNNENPTLLGVLNGKKYHADLYVRRIPLEEVPEEEDKCAAWLHKLYQEKDAFQEEYSRTGTFPETPVVPPRRPWTLVNWLFWASMLLYPFFRFVVNMVSSGSSLTLASFVLVFFVASMGVRWMIGVTEIDKGSAYGNMDSKQKHSD

SEQ ID NO: 14 - protein, 432 aa, Bos taurus
MCAPLCLSLVISLLGWISLKPLEGVGEFLSPSLPPRWPCSAVGVRCLGEEHDPGMDLVALLKSHFLCHLIFCYVFIVSGLIINTIQLCTLLLWPVNKQLFRKINCRLSYCVSSQLVMLLEWWSGTECVIYTDPRAYPKYGKENAIVVLNHKFEIDFLCGWSLAERFGVLGGSKVLAKKELAYVPIIGWMWYFTEMVFCTRKWEQDRKTVSESLLHLRDYPEKYFFLIHCEGTRFTEKKHQISMQVAQAKGLPSLKHHLLPRTKGFAVTVRSLRNVVSAVYDCTLNFRNNENPTLLGVLNGKKYHADLYVRRIPLEEVPEEEDKCAAWLHKLYQEKDAFQEEYSRTGTFPETPVVPPRRPWTLVNWLFWASMLLYPFFRFVVNMVSSGSSLTLASFVLVFFVASMGVRWMIGVTEIDKGSAYGNMDSKQKHSD

SEQ ID NO: 15 - protein, 378 aa, Bos taurus
MDLVALLKSHFLCHLIFCYVFIVSGLIINTIQLCTLLLWPVNKQLFRKINCRLSYCVSSQLVMLLEWWSGTECVIYTDPRAYPKYGKENAIVVLNHKFEIDFLCGWSLAERFGVLGGSKVLAKKELAYVPIIGWMWYFTEMVFCTRKWEQDRKTVSESLLHLRDYPEKYFFLIHCEGTRFTEKKHQISMQVAQAKGLPSLKHHLLPRTKGFAVTVRSLRNVVSAVYDCTLNFRNNENPTLLGVLNGKKYHADLYVRRIPLEEVPEEEDKCAAWLHKLYQEKDAFQEEYSRTGTFPETPVVPPRRPWTLVNWLFWASMLLYPFFRFVVNMVSSGSSLTLASFVLVFFVASMGVRWMIGVTEIDKGSAYGNMDSKQKHSD

SEQ ID NO: 16 - protein, 287 aa, Bos taurus
MELWPGAGTLLLLLFLLLLLLLPTLWFCSPSAKYFFKMAFYNGWILFLAVLAIPVCAVRGRNVENMKILRLMLLHIKYLYGIRVEVRGAHHFPPSQPYVVVSNHQSSLDLLGMMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGRCQVRVLPPVPTEGLKPDDVPALADRVRHSMLTVFREISTDGRGGGDYLKKPGGVGEAGL

SEQ ID NO: 17 - protein, 278 aa, Bos taurus
MELWPWLIAALLLLLLLAQLSRSARFYAKIGLYCAFCFTASAMAAVVCLLRHGGRTVENMRIISWFVRSFKYAYGLRFEVKGRETLDEDRPCVIISNHQSILDMMGLMEVLPDRCVQISKRELLFLGPVGLIMYLGGVLFINRQHSQTAMSVMTDVGERMVREKLKVWIYPEGTRNDNGDLLPFKKGAFYLAIQAQVPIIPVIYSSFSSFYSCKTKLFTSGTIQVEVLDAIPTRGLTVADVPKLLDTCHQAMRTHFFHISKIPQENGAPLGPDTQEAQ

SEQ ID NO: 18 - protein, 376 aa, Bos taurus
MGLLAFLKTQFVVHLLIGFVFVVSGLVINSIQLCTLVLWPVNKQLYRRQNCRLAYSLWSQLVMLLEWWSCTECTLFTDQATVDTFGKEHAVIILNHNFEIDFLCGWTMCERFGVLGSSKVLAKRELLYVPLIGWTWYFLEIVFCKRKWEEDRDTVIKGLKSLANYPEYMWFLLYCEGTRFTEKKHRVSMEVAASKGLPVLKYHLLPRTKGFTTAVQCLRGTVTAVYDVTLNFRGNKNPSLLGILYGKKYEADMCVRRFPLEEIPLDEKEAAQWLHKLYQEKDALQEIYNQKGVFPGQQFKPTRRPWTLLNFLFWATLLLSPLFSFVLGVFASGSPLLILTFLGFVGAASFGVRRLIGVTEIEKGSSYGNQEFKKKE

SEQ ID NO: 19 - protein, 365 aa, Bos taurus
MLLSLVLHMHSVRCVLPAAVLLGTAPTYVLVWGAWRLLSALLPSRFYQAVDDRLYCVYQSMVLFFFENYTGVQILLYGDLPKNKENIIYLANHQSTVDWIIADILAVRQSALGHVRYVLKDGLKWLPLYGCYFSQHGGIYVKRSAKFNENQMRKKLQRYINAGTPMYLVIFPEGTRYNPELTKVISASQAFAAQEGLPVLKHVLTPRIKATHVAFDSMKDYLDAVYDVTVAFEGSVDDKGQRKEAPSMAEFLCKECPKIHIHIDRIDKKNIPEEQVSMKRWLHERFEIKDKLLIEFYDSPDPERRNKFPGESVNSKLSLKKTLPSFLILSGLTAGLLMTEAGRKLYVKTWIYGTLIGCLWVSIKA

SEQ ID NO: 20 - protein, 356 aa, Arabidopsis thaliana
MDVASARSISSHPSYYGKPICSSQSSLIRISRDKVCCFGRISNGMTSFTTSLHAVPSEKFMGETRRTGIQWSNRSLRHDPYRFLDKKSPRSSQLARDITVRADLSGAATPDSSFPEPEIKLSSRLRGIFFCVVAGISATFLIVLMIIGHPFVLLFDPYRRKFHHFIAKLWASISIYPFYKINIEGLENLPSSDTPAVYVSNHQSFLDIYTLLSLGKSFKFISKTGIFVIPIIGWAMSMMGVVPLKRMDPRSQVDCLKRCMELLKKGASVFFFPEGTRSKDGRLGSFKKGAFTVAAKTGVAVVPITLMGTGKIMPTGSEGILNHGNVRVIIHKPIHGSKADVLCNEARSKIAESMDL

SEQ ID NO: 21 - protein, 283 aa, Homo sapiens
MDLWPGAWMLLLLLFLLLLFLLPTLWFCSPSAKYFFKMAFYNGWILFLAVLAIPVCAVRGRNVENMKILRLMLLHIKYLYGIRVEVRGAHHFPPSQPYVVVSNHQSSLDLLGMMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGQCQVRVLPPVPTEGLTPDDVPALADRVRHSMLTVFREISTDGRGGGDYLKKPGGGG

SEQ ID NO: 22 - protein, 384 aa, Spinacia oleracea
MMATPPAIAHLPLAISPVGSRGLFGSCNFKGSFLLPERRTSKIFLSGTPQFLGLENVNTLRSHTFNEFGACDKHFLRLKRSMKCRTLCFQSVGAFCHYIDPANRSEKFQFGRELHLLDRSLRHIAARSNVATSGTPDFSSPFPEASFGPKARGACFYAVTSVVALLLFGLMVVSHPFVLLFDRYRRRAQYFVAKTWATLTVIPFFNVEFEGLENLPRPDAPAVYVSNHQSFLDIYALLTVGRNFKFISKTSIFLFPIIGWAMYFLGVIPLKRMDSRSQLECLKRCMDLIRGGASVFFFPEGTRSKDGKLGSFKKGAFSVAAKTQVPVVPMTIIGTGSIMPAGKEGLLNPGSIKVVIHPCLVGNDAQVLCNQARSVISGTLEQQS

SEQ ID NO: 23 - protein, 534 aa, Mus musculus
MRLRGRGPRAAPSSSSGAGDARRLAPPGRNPFVHELRLSALQKAQVAFMTLTLFPIRLLFAAFMMLLAWPFALLASLGPPDKEPEQPLALWRKVVDFLLKAIMRTMWFAGGFHRVAVKGRQALPTEAAILTLAPHSSYFDAIPVTMTMSSIVMKAESRDIPIWGTLIRYIRPVFVSRSDQDSRRKTVEEIKRRAQSNGKWPQIMIFPEGTCTNRTCLITFKPGAFIPGVPVQPVVLRYPNKLDTITWTWQGPGALKILWLTLCQFQNQVEIEFLPVYCPSEEEKRNPALYASNVRRVMAKALGVSVTDYTFEDCQLALAEGQLRLPADTCLLEFARLVRGLGLKPENLEKDLDKYSESARMKRGEKIRLPEFAAYLEVPVSDALEDMFSLFDESGGGEIDLREYVVALSVVCRPSQTLATIQLAFKMYGSPEDGSIDEANLSCILKTALGVSELTVTDLFQAIDQEDKGRITFDDFCGFAEMYPDYAEDYLYPDQTHFDSCAQTPPAPTPNGFCIDFSPENSDFGRKNSCKKAD

SEQ ID NO: 24 - protein, 344 aa, Brassica napus
MDVASAPGVSSHPPYYSKPICSSQSSLIRIPINKGCCFARSSNLITSLHAASRGVTRRTSGVQWCYRSIRFDPFKVNDKNSRTVTVRSDLSGAATPESTYPEPEIKLSSRLRGICFCLVAGVSAIVLIVLMITGHPFVLLFDRYRRKFHHFIAKLWASISIYPFYKTDIQGLENLPSSDTPCVYVSNHQSFLDIYTLLSLGQSYKFISKTGIFVIPVIGWAMSMMGVVPLKRMDPRSQVDCLKRCMELVKKGASVFFFPEGTRSKDGRLGPFKKGAFTIAAKTGVPVVPITLMGTGKIMPTGSEGILNHGDVRVIIHKPIYGSKADLLCDEARNKIAESMNLVS

SEQ ID NO: 25 - protein, 216 aa, Rippkaea orientalis
MVDYEFQSREPIFNLIPYFLFKGIIIAPIFHTYFQGRIHGIQNLPVENPLIIVSNHASYFDPPILASSVNRPVAYMAKEELFEVPWLREGIRLYGAYPVKRGSGDRGAIRAALQALQEGWIVGIFLEGTRTPDGRIHDPKLGAAMIAAKAQLPLLPVCLWGTQKILQKGIPFPLPVPLTLRIGELIDPPASSKRGALEAVTQKCATAINALHDLGR

SEQ ID NO: 26 - protein, 199 aa, Arabidopsis thaliana
MILINSNSPTLISAVRFVGSSPFTTRGLSQSTVSISRNKSFFFHFTETKEKNARRDYLRVSIVCDAGGMFPVDPWAPTIDSQSIASQLFAVSLFPYIGFLYFLTKSKSAPKLTLFGFYFLLAFVGATIPAGIYAKVHYGTSLSNVDWLHGGAESLLALTNLFIVLGLRQALRKSQDDDDDKLGNDDEVPTTQEQGKSSV

SEQ ID NO: 27 - protein, 284 aa, Rattus norvegicus
MELWPGAWTALLLLLLLLLSTLWFCSSSAKYFFKMAFYNGWILFLAILAIPVCAVRGRNVENMKILRLLLLHVKYLYGIRVEVRGAQHFPPTQPYVVVSNHQSSLDLLGMMEVLPDRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGRCQVRVLPPVPTEGLTPDDVPALADRVRHSMLTIFREISTDGLGGGDCLKKPGGAGEARL

SEQ ID NO: 28 - protein, 269 aa, Mycolicibacterium smegmatis
MAATDTDQGEITKWDPGLTEKVMGWLRPLIKGYHRAEVHGLDTFPNGGALVVSNHSGGLFPMDVPVFATGFYEKFGYDRPVYTLSHDMLMTGPTADFFKKTGFIRANHENADEALRSGGVVVVFPGGDYDVYRPTLAANKIDFGGRTGYVRAALNAGVPIVPMVGVGGQETQLFLSRGTAVAKALGPIARLARTKIVPVSFGFPFGLSAVLPLNVPLPSKIVMKTLPPIDITAEFGEDPDIDEVDAHVRHVMQQALDELAEQRRFPVIG

SEQ ID NO: 29 - protein, 263 aa, Mycolicibacterium smegmatis
MEPVYGTVIQLARLAWRLQGLKFTVTGVENLPVTGGAVVAINHTSYFDFTFAGLPAYLQKRGRKVRFMAKKEVFDNKITGPIMRSLRHIEVDRHSGAASFEQACEYLKAGELVGVYPEATISRSFEIKELKSGAARMAIEADVPIIPHIVWGAQRIWTKGRPKNLYRPKVPIFIAVGEPIAPTLPAPELTALLHSRMQHLLEQVQDSYGPHPAGEFWVPHRLGGGAPSLAEANLMDAEEAAEKAARRAKQSGSGPAEPSGAPG

SEQ ID NO: 30 - protein, 253 aa, Mycolicibacterium smegmatis
MEPVFRSLEIAARLAVRATGSRITFSGLENLPATGGAVVAINHTSYVDFLPAGLAATERGRRMRFMIKAEMEQVAVIRYLIRHTGTIPVDRSAGAGAYAAAVEALRAGELVGVYPEATISRSFELKEFKTGAVRMALEAGVPIIPLIVWGAQRIWTKDHPRAIGRKKIPINVCVGPPIEASGSPDELGAALRAAMSDMLESAQRDYPAPPGAFWVPRRLGGGAPTPEEAKRRDEAELAERARKRAERKAKTNR

SEQ ID NO: 31 - protein, 276 aa, Mycolicibacterium smegmatis
MTTREHPWLPKASCDAGCVHSVEQGRRVIVWLRTAARLSAALVLLPGMPLLAVPLPGRSHVQRIYCRLLLRCLGVRIRLSGGPIRNLQGVLVVSGHVSWLDIFAIGSVLPGSFVARADLVEWTALGRVARLMKVIPIDRASLRRLPAVVATVADRLRAGRTVVAFPEGTTWCGLAHGPFRPAMFQAAVDAARPVQPLRLTYRHRDGRPSTTPAFVGQDTLLRSVCRVVTARRTVCHVHAGALQLPGDDRRALAARCEAEVRGEHERRDARTHAIAA

SEQ ID NO: 32 - protein, 332 aa, Mycolicibacterium smegmatis
MRLLRRAVTVPLVTVLMLGVLLYSVPAMALAVVADLVLRSSRPSRTVAAVVAYAAMELYALAKLLGGGQDGDRFTRDLVGKIYTIARRILDVEVLLDTGSVEPGEVPRDEPVIVFSRHCGPGDSLLIAWLLTFHYRLRTRIVLKGLLRCEPVLDLAGDLGCLCFLSRGGKRARAQVRELAASLAGGDALLLFPEGGNFSWARWHEAISRLRSSGRLREARRAWRQSYTLPPRTGGAAAAMAGAPHASVLVLTHSGFSADGRARPWWRLPVHRRLVVHVSLIPTEELPPREDLGPWLRDVWTEVDAWVAEHIEEGSPTRVLPHAHDEPQGSYL

SEQ ID NO: 33 - protein, 241 aa, Mycolicibacterium smegmatis
MWYWIFKFVLLGPLLALIGRPKVTGLENIPADGPAILASNHLAVMDSFYLPLVVSRRITFLAKKEYFTGTGIKGRFLAWFYTVVGQVPIDRTDADSAQDALNTAERILNQGKLLGMYPEGTRSPDGRLYKGKTGLARLALQTGVPVIPVAMVGTDVVNPPGHKGLRFGHVEVRIGKPMDFSRFDGLAGNRFIERAVIDEVMYELMRLSEQEYVDLYAADVKKAGDAAPAKPASRLPEAAAG

SEQ ID NO: 34 - protein, 260 aa, Mycolicibacterium smegmatis
MYGTVIQLARLAWRLQGLKFTVTGVENLPVTGGAVVAINHTSYFDFTFAGLPAYLQKRGRKVRFMAKKEVFDNKITGPIMRSLRHIEVDRHSGAASFEQACEYLKAGELVGVYPEATISRSFEIKELKSGAARMAIEADVPIIPHIVWGAQRIWTKGRPKNLYRPKVPIFIAVGEPIAPTLPAPELTALLHSRMQHLLEQVQDSYGPHPAGEFWVPHRLGGGAPSLAEANLMDAEEAAEKAARRAKQSGSGPAEPSGAPG

SEQ ID NO: 35 - protein, 263 aa, Mycolicibacterium smegmatis
MEPVYGTVIQLARLAWRLQGLKFTVTGVENLPVTGGAVVAINHTSYFDFTFAGLPAYLQKQGRKVRFMAKKEVFDNKITGPIMRSLRHIEVDRHSGAPSFEQACEYLKAGELVGVYPEATISRSFEIKELKSGAARMAIEADVPIIPHIVWGAQRIWTKGRPKNLYRPKVPIFIAVGEPIAPTLPAPELTALLHSRMQHLLEQVQDSYGPHPAGEFWVPHRLGGGAPSLAEANLMDAEEAAEKAARRAKQSGSGPAEPSGAPG

SEQ ID NO: 36 - protein, 263 aa, Mycolicibacterium smegmatis
MDTSELDAWDPVAARQVRSLAGPLAKWWFRAEVRGLDNIPPGGGALVVANHSGGMLTPDVLIFAPEFYRHFGYGRPLYTLAHYGVLMGPTGALLRRIGVITASRENAAAALHSGAVVLVFPGGDYDAYRPTFGANTIDFNGRTGYIRTALAADVPIVPTVSIGAQESQLFLSRGHWLAKRLGLPRIRMDILPVSFGLPFGPSVIVPPNLPLPTKIVTEVLPPIDLTARFGTDPDIDEADSHIRHVMQAALDRLAAKRRFPVVG

SEQ ID NO: 37 - protein, 269 aa, Mycolicibacterium smegmatis
MAATDTDPGEITKWDPGLTEKVMGWLRPLIKGYHRAEVHGLDTFPNGGALVVSNHSGGLFPMDVPVFATGFYEKFGYDRPVYTLSHDMLMTGPTADFFKKTGFIRANHENADEALRSGGVVVVFPGGDYDVYRPTLAANKIDFAGRTGYVRAALNAGVPIVPMVGVGGQETQLFLSRGTAVAKALGPIARLARTKIVPVSFGFPFGLSAVLPLNVPLPSKIVMKTLPPIDITAEFGEDPDIDEVDAHVRHVMQQALDELAEQRRFPVIG

SEQ ID NO: 38 - protein, 269 aa, Mycolicibacterium smegmatis
MAATDTDPGEITKWDPGLTEKVMGWLRPLIKGYHRAEVHGLDTFPTGGALVVSNHSGGLFPMDVPVFATGFYEKFGYDRPVYTLSHDMLMTGPTADFFKKTGFIRANHENADEALRSGGVVVVFPGGDYDVYRPTLAANKIDFAGRTGYVRAALNAGVPIVPMVGVGGQETQLFLSRGTAVAKALGPIARLARTKIVPVSFGFPFGLSAVLPLNVPLPSKIVMKTLPPIDITAEFGEDPDIDEVDAHVRHVMQQALDELAEQRRFPVIG

SEQ ID NO: 39 - protein, 549 aa, Diutina rugosa
MELALALSLIASVAAAPTATLANGDTITGLNAIINEAFLGIPFAEPPVGNLRFKDPVPYSGSLDGQKFTSYGPSCMQQNPEGTYEENLPKAALDLVMQSKVFEAVSPSSEDCLTINVVRPPGTKAGANLPVMLWIFGGGFEVGGTSTFPPAQMITKSIAMGKPIIHVSVNYRVSSWGFLAGDEIKAEGSANAGLKDQRLGMQWVADNIAAFGGDPTKVTIFGESAGSMSVMCHILWNDGDNTYKGKPLFRAGIMQSGAMVPSDAVDGIYGNEIFDLLASNAGCGSASDKLACLRGVSSDTLEDATNNTPGFLAYSSLRLSYLPRPDGVNITDDMYALVREGKYANIPVIIGDQNDEGTFFGTSSLNVTTDAQAREYFKQSFVHASDAEIDTLMTAYPGDITQGSPFDTGILNALTPQFKRISAVLGDLGFTLARRYFLNHYTGGTKYSFLSKQLSGLPVLGTFHSNDIVFQDYLLGSGSLIYNNAFIAFATDLDPNTAGLLVKWPEYTSSSQSGNNLMMINALGLYTGKDNFRTAGYDALFSNPPSFFV

SEQ ID NO: 40 - protein, 268 aa, Streptomyces rimosus
MRLSRRAATASALLLTPALALFGASAAVSAPRIQATDYVALGDSYSSGVGAGSYDSSSGSCKRSTKSYPALWAASHTGTRFNFTACSGARTGDVLAKQLTPVNSGTDLVSITIGGNDAGFADTMTTCNLQGESACLARIAKARAYIQQTLPAQLDQVYDAIDSRAPAAQVVVLGYPRFYKLGGSCAVGLSEKSRAAINAAADDINAVTAKRAADHGFAFGDVNTTFAGHELCSGAPWLHSVTLPVENSYHPTANGQSKGYLPVLNSAT

SEQ ID NO: 41 - protein, 563 aa, Geotrichum candidum
MVSKTFFLAAALNVVGTLAQAPTAVLNGNEVISGVLEGKVDTFKGIPFADPPVGDLRFKHPQPFTGSYQGLKANDFSSACMQLDPGNAISLLDKVVGLGKIIPDNLRGPLYDMAQGSVSMNEDCLYLNVFRPAGTKPDAKLPVMVWIYGGAFVFGSSASYPGNGYVKESVEMGQPVVFVSINYRTGPYGFLGGDAITAEGNTNAGLHDQRKGLEWVSDNIANFGGDPDKVMIFGESAGAMSVAHQLVAYGGDNTYNGKQLFHSAILQSGGPLPYFDSTSVGPESAYSRFAQYAGCDASAGDNETLACLRSKSSDVLHSAQNSYDLKDLFGLLPQFLGFGPRPDGNIIPDAAYELYRSGRYAKVPYITGNQEDEGTILAPVAINATTTPHVKKWLKYICSEASDASLDRVLSLYPGSWSEGAPFRTGILNALTPQFKRIAAIFTDLLFQSPRRVMLNATKDVNRWTYLATQLHNLVPFLGTFHGSDLLFQYYVDLGPSSAYRRYFISFANHHDPNVGTNLKQWDMYTDSGKEMLQIHMIGNSMRTDDFRIEGISNFESDVTLFG

SEQ ID NO: 42 - protein, 563 aa, Geotrichum candidum
MVSKSLFLAAAVNLAGVLAQAPRPSLNGNEVISGVLEGKVDTFKGIPFADPPLNDLRFKHPQPFTGSYQGLKANDFSPACMQLDPGNSLTLLDKALGLAKVIPEEFRGPLYDMAKGTVSMNEDCLYLNVFRPAGTKPDAKLPVMVWIYGGAFVYGSSAAYPGNSYVKESINMGQPVVFVSINYRTGPFGFLGGDAITAEGNTNAGLHDQRKGLEWVSDNIANFGGDPDKVMIFGESAGAMSVAHQLIAYGGDNTYNGKKLFHSAILQSGGPLPYHDSSSVGPDISYNRFAQYAGCDTSASANDTLECLRSKSSSVLHDAQNSYDLKDLFGLLPQFLGFGPRPDGNIIPDAAYELFRSGRYAKVPYISGNQEDEGTAFAPVALNATTTPHVKKWLQYIFYDASEASIDRVLSLYPQTLSVGSPFRTGILNALTPQFKRVAAILSDMLFQSPRRVMLSATKDVNRWTYLSTHLHNLVPFLGTFHGNELIFQFNVNIGPANSYLRYFISFANHHDPNVGTNLLQWDQYTDEGKEMLEIHMTDNVMRTDDYRIEGISNFETDVNLYG

SEQ ID NO: 43 - protein, 268 aa, Streptomyces coelicolor
MRRFRLVGFLSSLVLAAGAALTGAATAQAAQPAAADGYVALGDSYSSGVGAGSYISSSGDCKRSTKAHPYLWAAAHSPSTFDFTACSGARTGDVLSGQLGPLSSGTGLVSISIGGNDAGFADTMTTCVLQSESSCLSRIATAEAYVDSTLPGKLDGVYSAISDKAPNAHVVVIGYPRFYKLGTTCIGLSETKRTAINKASDHLNTVLAQRAAAHGFTFGDVRTTFTGHELCSGSPWLHSVNWLNIGESYHPTAAGQSGGYLPVLNGAA

SEQ ID NO: 44 - protein, 526 aa, Ricinus communis
MDDAGKITSTSHLIVSPDEGTFLDLFKHIVLSDLGSGAKFFRASDQRVPATAAYYSRWPVSVFICKILQLFQMPAAMLGHLTDFLLNFYYQNHGFLGILRNIFLIRLKIPKRGEADFISTIGYLDSRMDLHGTPMVSHQADEVISNADNPSLKEGHNSKIKGALGNRSLMDLCIMASKLAYENTKVVERVVAEHWKMHFVADYGGMNYFQDARNTHAFIFCDKPKDANLIVISFRGTGPFSIPNWCTDFDFSLVGLGDAGSVHVGFLEAMGLGHRNSISSFETSINTKSPGSITELRKESEMAPDHLVWAYDGVYFLAASTLKGLLKDHKNAKFVVTGHSLGGALAILFTCILEIQQETEVLDRLLNVYTFGQPRIGNYNLGYFMQNRLNFPERRYFRVVYCNDMVPRVPFDDVFFTFEHFGTCIYYDSRFFGYFTKEEPSRNPFGIENAISAHITAWWELWRSFILNHVYGAEYKETWESRMFRILGLFLPGVAAHSPVNYVNSVRLGRELAIPLMSLKMMAQGY

SEQ ID NO: 45 - protein, 428 aa, Amycolatopsis mediterranei
MFRKLRWAVALAAVAVVLGIVTPVGARPAFAAGNPYQLGPDPTTASVAATRGTFATAELTVGGGNGFAAGKIYYPTDTSQGTFGAIAIVPGYTATWAAEGAWMGPWLASFGFVVIGIDTLSRNDYDTARGTQLLAALDYLTQRSSVRDRVDTKRLAVMGHSMGGGGAMYAALHRPSLWAAVGLAPFSPSQNLTTDQVPTLLLAGQNDTTVTPSSVQSLYNGIPAAVEKGYLELTGAGHSFPTSSNSVMMRRVIPWLKIFVDRDTRYSKFLCPSLADSTGISGYRSTCPLDVPGGGDPGPGDQVRLVGAGSGKCVDVPNQSQANGTALVVWTCNGGTNQRWTPTAAGELRVYNGAKCMDAGGGQPGTAVTINSCGGRPGQKWTVNANGTITNAQAGACLDVSGAGTADNTPVIVWNCTGGANQAWTRQV

SEQ ID NO: 46 - protein, 478 aa, Thermosyntropha lipolytica
MLKKNSTIALCFLLSFVFNIFLTNPVLAQEISSNNKYPIVLVHGLGGFGRDEMLGFKYWGGLYDIQEYLKAQGYEVYTVAVGPVSSNWDRACELYAQLVGGRVDYGAAHAAKYGHARYGRTYEGLIPDLGKVDPQTGEVKKVHLIGHSMGGQTVRTLVQLLAEGDAEERSFPQDNMSPLFAGGNNWVKSVTTISTPHDGTSLDNAINNGLPWLQSFVGFMSTLSTPNSLYDLKLDQWGLTRCQGEKVADYLKRVFNSSFWKTSRDLSNWDLTVEGARELNGWVKAQPDVYYFSWATNATRKSLFSNYQVPILSMNPFLYPFALHIGSYTRNIPGQIPIDSSWWPNDGLVSLISQNGPKINSTDTIINFNGNPQPGVWNYMGVMDTFDHMDIIGIGTLWNPCPWYLEIAKLLTSLPADYAVVADGETENSCSASDLMNPDEAEITATEAADVSGENSTSAETIEENTISYPDITDIAEE

SEQ ID NO: 47 - protein, 523 aa, Thermosyntropha lipolytica
MGKILKHRYLSLFILLIVFLELMGFPQFVYASQNCNSSGNKYPIVLVHGLGGFGRDELGGVIKYWGGVYDIQEYLKSRGYEVYTVSIGPVSSNWDRACELYAQLVGGTVDYGAAHAAKYGHKRYGRTYPGLIPDLGKIDPKTGEMKKVHLIGHSMGGQTIRTLVQLLAEGCEEERNYSQENVSPLFMGGNNWVKSVTTISTPHDGTSLADYYYNDPKSVTWRQHLIGLIASTPLSDNSNLKYDLKLDQWGLTYKKEESTYEYLKRIINSSFWMTNRDLANYDVSIEGAAELNSWVKAQPDVYYFSWATQATTKSRFSDYQVPIWSMYLEGWQSAYFMGSYTRNIPGKIPVTSEWWPNDGAVNVISQNGPKINSNDRIINFDGNPVPGVWNFMGIMDTFDHRDIIGLGTYWNPCPWYLKHVELLAKLPTDYISIPKDIEEDIILDRDCMPDNEIGEFINDDNNYVDNHNSSLDDTTSDEITEKMREVNDRESSVDREVYNDSNDINPGLSEPGENKDYESDCAR

SEQ ID NO: 48 - protein, 631 aa, Penaeus vannamei
MTSPPPPAAPDAPLGCPARRRNTRGCLNPKRRQRIPLADKASGELCLSLPASLPPLARHFHSSPIAPSLPQAIAPSRFPQFSLQGKGTKENGGPAYTVPMEFELPVRPREMPTHIPLVPSNPLVLSTSCSQRKKKIMEENTRQEDKEWCDPVLGCLSITEDWYHPNRPINVCPDSRAHINTRFMLHTRNEPGETTDTFLTADKAVIDATTFDPAKPIKFITHGFIDTGNTEWLRRMARAMITQGDYNVIRVNWGAGSLPMYYSATANTRVVGLEIAYLVNFFIDNYGVDPANVHLIGHSLGSHVSGYAGERISGLGRITGLDPAGPYFTETPSFIHLDATDAVFVDNIHTDADTIYVLGYGTEQEMGNVDFYPNSGHDQPGCDPVSIGIEIIDDIGEGGRDLAACSHDRSVELFEDSLGEPCPYLAHECIDYDSFEQGRCASCNEDNSACAFMGIHADQYTAKTRENVRMYFDTDSKAPYCYYHYQIVIDTAHPKNAEDWVQGHLTLWLYGDNGNVIEKVQITRDHERFDHGQPKYFLLTSHVDISRVIRVEAHWEYDDTLTNPGSYCWMLLCNRALYVRSVRISSMEYYPEESRLDHTRVVCDRSSDYLEIKSGHTAVLTSEDSCVFTIA

SEQ ID NO: 49 - protein, 346 aa, Oryza sativa
MERWRCVSVLALVLLLSNASHGRDISVQHSQQTLNYSHTLAMTLVEYASAVYMTDLTALYTWTCSRCNDLTQGFEMKSLIVDVENCLQAFVGVDYNLNSIIVAIRGTQENSMQNWIKDLIWKQLDLSYPNMPNAKVHSGFFSSYNNTILRLAITSAVHKARQSYGDINVIVTGHSMGGAMASFCALDLAINLGSNSVQLMTFGQPRVGNAAFASYFAKYVPNTIRVTHGHDIVPHLPPYFSFLPHLTYHHFPREVWVNDSEGDITEQICDDSGEDPNCCRCISTWSLSVQDHFTYLGVDMEADDWSTCRIITAENVRQLQKDLASNIIVSKHSVDVTIVEPSSQTY

SEQ ID NO: 50 - protein, 398 aa, Solanum lycopersicum
MACIFAEKWEELSGKNNWDGLLNPLDLDLRKYIIHYGELAQATYDTFISERASKYAGASRYSMENFFTKVGLDPKKYCVTKYFYATSSMPLPDAFITKSLSREAWSKESNFMGYIAVATDEGKASLGRRDIVINWRGTLQVLEWVNDLQFLLVPAPQVFGDGGLLPLFHPLVHHGFHNIYTTENPRSQFNKTCVRDQVMEEVKRLVEEYKDEEVSITVTGHSLGASLATLNAVDIAFNKINKASNGKEFPVTAFVFASPKVGDVNFLNAFSKLKHLHILRIHNVLDIVPKYPPIGYFDVGQEIMIDTTKSPYVKPPGEPVSWHLLEPYLHGIAGTQGIGMLAGFKLEVNRDISLVNKQWNVLKDEHCIPPLWWSEKHKGMVQQEDGTWLLQDRDEYEF

SEQ ID NO: 51 - protein, 462 aa, Pseudozyma aphidis
MRVSLRSITSLLAAATAAVLAAPATETLDRRAALPNPYDDPFYTTPSNIGTFAKGQVIQSRKVPTDIGNANNAASFQLQYRTTNTQNEAVADVATVWIPAKPASPPKIFSYQVYEDATALDCAPSYSYLTGLDQPNKVTAVLDTPIIIGWALQQGYYVVSSDHEGFKAAFIAGYEEGMAILDGIRALKNYQNLPSDSKVALEGYSGGAHATVWATSLADSYAPELNIVGASHGGTPVSAKDTFTFLNGGPFAGFALAGVSGLSLAHPDMESFIEARLNAKGQQTLKQIRGRGFCLPQVVLTYPFLNVFSLVNDTNLLNEAPIAGILKQETVVQAEASYTVSVPKFPRFIWHAIPDEIVPYQPAATYVKEQCAKGANINFSPYPIAEHLTAEIFGLVPSLWFIKQAFDGTTPKVICGTPIPAIAGITTPSADQVLGSDLANQLRSLNGKQSAFGKPFGPITPP

SEQ ID NO: 52 - protein, 456 aa, Bos taurus
MFLLLPFDSLIVSLLGISLTVLFTLLLVFIIVPAVFGVSFGIRKLYMKTLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCLLLPLRIALAFTGISLLVVGTTMVGYLPNGRFKEFLSKHVHLMCYRICVRALTAIITYHDRKNRPRNGGICVANHTSPIDVIILASDGYYAMVGQVHGGLMGVIQRAMVKACPHVWFERSEVKDRHLVARRLTEHVQDKSKLPILIFPEGTCINNTSVMMFKKGSFEIGATVYPVAIKYDPQFGDAFWNSSKYGMVTYLLRMMTSWAIVCSVWYLPPMTRQAEEDAVQFANRVKSAIARQGGLVDLLWDGGLKREKVKDTFKEEQQKLYSKMIVGNHEDRSRS

SEQ ID NO: 53 - protein, 396 aa, Bos taurus
MERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCLLLPLRIALAFTGISLLVVGTTMVGYLPNGRFKEFLSKHVHLMCYRICVRALTAIITYHDRKNRPRNGGICVANHTSPIDVIILASDGYYAMVGQVHGGLMGVIQRAMVKACPHVWFERSEVKDRHLVARRLTEHVQDKSKLPILIFPEGTCINNTSVMMFKKGSFEIGATVYPVAIKYDPQFGDAFWNSSKYGMVTYLLRMMTSWAIVCSVWYLPPMTRQAEEDAVQFANRVKSAIARQGGLVDLLWDGGLKREKVKDTFKEEQQKLYSKMIVGNHEDRSRS

SEQ ID NO: 54 - protein, 794 aa, Bos taurus
MNTMAEARLQTQKKSSQDGQETSLWSSGFGMKLEAVTPFLGKYRPFVGRCCQTCTPKSWESLFHRSIMDLGFCNVILVKEENTRFRGWLVRRLCYFLWSLEQHIPPCQDASQKIMESTGVQNVISGRAPGGAGEGQVPSHVRKEVQRILGHIQAPPRPFLLRLFSWALLRFLNCLFLNVQLYRGQMKMVQKASQAGSPLVFLSTHKSVLDGILLPFVLLSQGVGVLRVAWDPRTCSPLLRALLKKLGGLFLPPEANLSPDSPEGVLARAVVHATVEQLLASRQPLLIFLEEPPGVRGPRLSALGLSWLGLVVQGVQAGIVPDTLLVPVAVTYDLVPEAPHDTCHALAPLGLWTGALAVLRSLRRWGCGRRVCVRVNLAQPFSLQEYIIDARSCWGSRQTLEQLLQPIVLGQCTAVPDTEKEQEWTPVTGPLLALREEDQLLVRRLSWHVLNASVASSAVMSTAIMATLLLFKHQKLLGEFSWLTEETLLRGFDVGFSGQLRCLVQHTLSLLRPHVALLRIQQGDLLVVPRPGPGLTSLARLSAELLPTFLSEAVGACAVRGLLAGRVPPEGPWELQGVELLSQKELYCQILLLLHLLPQDLLLLQPCQSCYCYCQEVLDRLIQCGLLVAEETRGSQPACDTGRQRLSARLLWKLSGDFTDSDSDDFEEAEGRYFRLSQQSRCPDFFLFLCRLLSPVLKAFAQAAAFLHRGRLPDTESGYTEQLFQFLRATAQEEGLFECADPNLAISAIWTFRDLGVLQQTPGPTGPMLHLSPAFASRDSQEKLGQFIRQFICS

SEQ ID NO: 55 - protein, 438 aa, Bos taurus
MDGAELAGQILYTWLTLVLGLILLPSAFGVSLGISEIYMKILVKTLEWATLRIETGVAKQSVLKNSASVGIIQRDESPMEKGLSGLRGRDFELSDVFYFSKKGLEAIVEDEVTQRFSSEELVSWNLLTRTNVNFQYVSPRLTMVWVLGVIVRYCVLLPLRLTLAVIGISLFVIGTTLVGQLPRNRLKNFLSEVVHLTCCRICVRALSGTIHYHNRQYRPQKGGICVANHTSPIDVLILTTDGCYTMVGQVHGGLMGIIQRSMVKACPHIWFERSEMKDRHLVIRRLKEHIALKEELPILIFPEGTCINNTSVMMFKKGSFEIGGTIHPVAIKYNPRFGDAFWNSSKYNIVSYLLRVMTSWAIVCDVWYMPPMTREEGEDAVQFANRVKSAIAVQGGLTELPWDGGLKRAKVKDTFKEEQQKNYSKMIVGNGSLKSELD

SEQ ID NO: 56 - protein, 413 aa, Bos taurus
MDGAELAGQILYTWLTLVLGLILLPSAFGVSLGISEIYMKILVKTLEWATLRIETGVAKQSVLKNSASVGIIQRDESPMEKGLSGLRGRDFELSDVFYFSKKGLEAIVEDEVTQRFSSEELVSWNLLTRTNVNFQYVSPRLTMVWVLGVIVRYCVLLPLRLKNFLSEVVHLTCCRICVRALSGTIHYHNRQYRPQKGGICVANHTSPIDVLILTTDGCYTMVGQVHGGLMGIIQRSMVKACPHIWFERSEMKDRHLVIRRLKEHIALKEELPILIFPEGTCINNTSVMMFKKGSFEIGGTIHPVAIKYNPRFGDAFWNSSKYNIVSYLLRVMTSWAIVCDVWYMPPMTREEGEDAVQFANRVKSAIAVQGGLTELPWDGGLKRAKVKDTFKEEQQKNYSKMIVGNGSLKSELD

SEQ ID NO: 57 - protein, 360 aa, Bos taurus
MEKGLSGLRGRDFELSDVFYFSKKGLEAIVEDEVTQRFSSEELVSWNLLTRTNVNFQYVSPRLTMVWVLGVIVRYCVLLPLRLTLAVIGISLFVIGTTLVGQLPRNRLKNFLSEVVHLTCCRICVRALSGTIHYHNRQYRPQKGGICVANHTSPIDVLILTTDGCYTMVGQVHGGLMGIIQRSMVKACPHIWFERSEMKDRHLVIRRLKEHIALKEELPILIFPEGTCINNTSVMMFKKGSFEIGGTIHPVAIKYNPRFGDAFWNSSKYNIVSYLLRVMTSWAIVCDVWYMPPMTREEGEDAVQFANRVKSAIAVQGGLTELPWDGGLKRAKVKDTFKEEQQKNYSKMIVGNGSLKSELD

SEQ ID NO: 58 - protein, 296 aa, Bos taurus
MVWVLGVIVRYCVLLPLRLTLAVIGISLFVIGTTLVGQLPRNRLKNFLSEVVHLTCCRICVRALSGTIHYHNRQYRPQKGGICVANHTSPIDVLILTTDGCYTMVGQVHGGLMGIIQRSMVKACPHIWFERSEMKDRHLVIRRLKEHIALKEELPILIFPEGTCINNTSVMMFKKGSFEIGGTIHPVAIKYNPRFGDAFWNSSKYNIVSYLLRVMTSWAIVCDVWYMPPMTREEGEDAVQFANRVKSAIAVQGGLTELPWDGGLKRAKVKDTFKEEQQKNYSKMIVGNGSLKSELD

SEQ ID NO: 59 - protein, 462 aa, Mus musculus
MFLLLPFDSLIVNLLGISLTVLFTLLLVFIIVPAIFGVSFGIRKLYMKTLLKIFAWATLRMERGAKERNHQLYKPYTNGIIAKDPTSLEEEIKEIRRSGSSKALDKTPEFELSDIFYFCRKGMETIMDDEVTKRFSAEELESWNLLSRTNYNFQYISLRLTILWGLGVLIRYCFLLPLRIALAFTGIGLLVVGTTMVGYLPNGRFKEFLSKHVHLMCYRICVRALTAIITYHNRKNRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKPPLLVQYDPQFGDAFWNSSKYGMVTYLLRMMTSWAIVCSVWYLPPMTREKDEDAVQFANRVKSAIARQGGLVDLLWDGGLKREKVKDTFKEEQQKLYSKMIVGNHEDRSRS

SEQ ID NO: 60 - protein, 828 aa, Homo sapiens
MDESALTLGTIDVSYLPHSSEYSVGRCKHTSEEWGECGFRPTIFRSATLKWKESLMSRKRPFVGRCCYSCTPQSWDKFFNPSIPSLGLRNVIYINETHTRHRGWLARRLSYVLFIQERDVHKGMFATNVTENVLNSSRVQEAIAEVAAELNPDGSAQQQSKAVNKVKKKAKRILQEMVATVSPAMIRLTGWVLLKLFNSFFWNIQIHKGQLEMVKAATETNLPLLFLPVHRSHIDYLLLTFILFCHNIKAPYIASGNNLNIPIFSTLIHKLGGFFIRRRLDETPDGRKDVLYRALLHGHIVELLRQQQFLEIFLEGTRSRSGKTSCARAGLLSVVVDTLSTNVIPDILIIPVGISYDRIIEGHYNGEQLGKPKKNESLWSVARGVIRMLRKNYGCVRVDFAQPFSLKEYLESQSQKPVSALLSLEQALLPAILPSRPSDAADEGRDTSINESRNATDESLRRRLIANLAEHILFTASKSCAIMSTHIVACLLLYRHRQGIDLSTLVEDFFVMKEEVLARDFDLGFSGNSEDVVMHAIQLLGNCVTITHTSRNDEFFITPSTTVPSVFELNFYSNGVLHVFIMEAIIACSLYAVLNKRGLGGPTSTPPNLISQEQLVRKAASLCYLLSNEGTISLPCQTFYQVCHETVGKFIQYGILTVAEHDDQEDISPSLAEQQWDKKLPEPLSWRSDEEDEDSDFGEEQRDCYLKVSQSKEHQQFITFLQRLLGPLLEAYSSAAIFVHNFSGPVPEPEYLQKLHKYLITRTERNVAVYAESATYCLVKNAVKMFKDIGVFKETKQKRVSVLELSSTFLPQCNRQKLLEYILSFVVL

SEQ ID NO: 61 - protein, 462 aa, Cucurbita moschata
MFILSSSSSTLPSAPPFSSTTSIFLSFSRVSLPPSSSSLKLLPLSLQFGPPKLASSCSLRFSASRAMAELIQDKESAQSAATAAAASSGYERRNEPAHSRKFLDVRSEEELLSCIKKETEAGKLPPNVAAGMEELYQNYRNAVIESGNPKADEIVLSNMTVALDRILLDVEDPFVFSSHHKAIREPFDYYIFGQNYIRPLIDFGNSFVGNLSLFKDIEEKLQQGHNVVLISNHQTEADPAIISLLLEKTNPYIAENTIFVAGDRVLADPLCKPFSIGRNLICVYSKKHMFDIPELTETKRKANTRSLKEMALLLRGGSQLIWIAPSGGRDRPDPSTGEWYPAPFDASSVDNMRRLIQHSDVPGHLFPLALLCHDIMPPPSQVEIEIGEKRVIAFNGAGLSVAPEISFEEIAATHKNPEEVREAYSKALFDSVAMQYNVLKTAISGKQGLGASTADVSLSQPW

SEQ ID NO: 62 - protein, 434 aa, Homo sapiens
MEGAELAGKILSTWLTLVLGFILLPSVFGVSLGISEIYMKILVKTLEWATIRIEKGTPKESILKNSASVGIIQRDESPMEKGLSGLRGRDFELSDVFYFSKKGLEAIVEDEVTQRFSSEELVSWNLLTRTNVNFQYISLRLTMVWVLGVIVRYCVLLPLRVTLAFIGISLLVIGTTLVGQLPDSSLKNWLSELVHLTCCRICVRALSGTIHYHNKQYRPQKGGICVANHTSPIDVLILTTDGCYAMVGQVHGGLMGIIQRAMVKACPHVWFERSEMKDRHLVTKRLKEHIADKKKLPILIFPEGTCINNTSVMMFKKGSFEIGGTIHPVAIKYNPQFGDAFWNSSKYNMVSYLLRMMTSWAIVCDVWYMPPMTREEGEDAVQFANRVKSAIAIQGGLTELPWDGGLKRAKVKDIFKEEQQKNYSKMIVGNGSLS

SEQ ID NO: 63 - protein, 801 aa, Mus musculus
MDTMLKSNPQTQQRSNHNGQETSLWSSSFGMKMEAITPFLGKYRPFMGRCCQTCTPKSWESLFHRSIMDLGFCNVILVKEENTRFRGWLVRRLCYFLWSLEQHIPTSFDASQKIMENTGVQNLLSGRVPGAAGEGQAPELVKKEVQRILGHIQTTPRPFLLRLFSWALLWFLNRLFLNVQLHKGQMKMVQKAVQEGSPLVFLSTHKSLLDGFLLPFVLFSQGLGVVRVALDSRTCSPALRALLRKLGGLFLPPEVNLSLDNSEGILARAVVRATVEELLTSGQPLLIFLEEPPGSPGPRLSALGQAWLGVVIQAVQAGIISDATLVPVAIAYDLVPDAPCNMNHDLAPLGLWTGALAVFRRLCNCWGCNRRVCVRVHLAQPFSLQEYTINARSCWDSRQTLEHLLQPIVLGECSVVPDTEKEQEWTPPTGLLLALKEEDQLLVRRLSRHVLSASVASSAVMSTAIMATLLLLKHQKGVVLSQLLGEFSWLTEETLLRGFDVGFSGQLRCLAQHTLSLLRAHVVLLRVHQGDLVVVPRPGPGLTHLARLSMELLPTFLSEAVGACAVRGLLAGRVPPEGPWELQGIELLSQNELYRQILLLLHLLPQDLLLPQPCQSSYCYCQEVLDRLIQCGLLVAEETPGSRPACDTGRQHLSAKLLWKPSGDFTDSESDDFEEPGGRCFRLSQQSRCPDFFLFLCRLLSPILKAFAQAATFLHLGQLPDSEVAYSEKLFQFLQACAQEEGIFECADPNLAISAVWTFKDLGVLQEMPSPTGPQLHLSPTFATRDNQDKLEQFIRQFICS

SEQ ID NO: 64 - protein, 566 aa, Bos taurus
MGDRGGAGGSRRRRTGSRPSIQGGSGPAAAEEEVRDVGAGGDAPVRDTDKDGDVDVGSGHWDLRCHRLQDSLFSSDSGFSNYRGILNWCVVMLILSNARLFLENLIKYGILVDPIQVVSLFLKDPYSWPALCLVIVANIFAVAAFQVEKRLAVGALTEQAGLLLHGVNLATILCFPAAVAFLLESITPVGSVLALMVYTILFLKLFSYRDVNLWCRERRAGAKAKAALAGKAANGGAAQRTVSYPDNLTYRGEDPAGGWGDCPAAWPASPALPSRSLLLPLRPHPVLRAQLPPLPPHPKALPAAATPGDAVPHPAPGGADPAVDGPGHPELHEALQGHGLLPHRGAPPEAGGEWPAGWGRVGAGGAVLAPGTHSPQVPNHLIWLIFFYWLFHSCLNAVAELMQFGDREFYRDWWWVALPGRGWWGPPLGLGPEPLPTLPRPRRNSESITYFWQNWNIPVHKWCIRHFYKPMLRRGSSKWAARTAVFLASAFFHEYLVSIPLRMFRLWAFTGMMAQIPLAWIVGRFFRGNYGNAAVWLSLIIGQPVAVLMYVHDYYVLNREAPAAGT

SEQ ID NO: 65 - protein, 467 aa, Bos taurus
MGDRGGAGGSRRRRTGSRPSIQGGSGPAAAEEEVRDVGAGGDAPVRDTDKDGDVDVGSGHWDLRCHRLQDSLFSSDSGFSNYRGILNWCVVMLILSNARLFLENLIKYGILVDPIQVVSLFLKDPYSWPALCLVIVANIFAVAAFQVEKRLAVGALTEQAGLLLHGVNLATILCFPAAVAFLLESITPVGSVLALMVYTILFLKLFSYRDVNLWCRERRAGAKAKAALADLYYFLFAPTLCYELNFPRSPRIRKRFLLRRLLEMLFLTQLQVGLIQQWMVPAIQNSMKPFKDMDYSRIVERLLKLAVPNHLIWLIFFYWLFHSCLNAVAELMQFGDREFYRDWWNSESITYFWQNWNIPVHKWCIRHFYKPMLRRGSSKWAARTAVFLASAFFHEYLVSIPLRMFRLWAFTGMMAQIPLAWIVGRFFRGNYGNAAVWLSLIIGQPVAVLMYVHDYYVLNREAPAAGT

SEQ ID NO: 66 - protein, 361 aa, Bos taurus
MKTLIAAYSGVLRGTGSSILSALQDLFSVTWLNRSKVEKQLQVISVLQWVLSFLVLGVACSVILMYTFCTDCWLIAVLYFTWLVFDWNTPKKGGRRSQWVRNWAVWRYFRDYFPIQLVKTHNLLTSRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLRNRKGFVKLALRHGADLVPTYSFGENEVYKQVIFEEGSWGRWVQKKFQKYIGFAPCIFHGRGLFSSDTWGLVPYSKPITTVVGEPITIPRLERPTQQDIDLYHAMYVQALVKLFDQHKTKFGLPETEVLEVN

SEQ ID NO: 67 - protein, 339 aa, Bos taurus
MAMAFLSQLNLQEILQTLSVLQWMPVYVFLGAIPIIVIPYFLVFTKFWMVSVLALAWLAYDWNTHSQGGRRSAWVRNWTIWKYFQNYFPIKLVKTHDLSPRHNYIIASHPHGVLPYGTFINFATETTGFARIFPGITPYVATLEGIFWIPIVREYVMSMGVCPVSELALKYLLTQKGSGNAVVIMVGGGAEALLCHPGATTVLLKQRKGFVKVALETGAYLVPSYSFGQNEVHNQETFPEGTWKRFFQKALQDTLKKLLRLSVCTFHGRGLTRGSWGFLPFNHPITTVVGEPLPIPRIKKPNEETVDKYHALYINALQKLFDEHKVQYGLSETQELTII

SEQ ID NO: 68 - protein, 526 aa, Vernicia fordii
MTIPETPDNSTDATTSGGAESSSDLNLSLRRRRTASNSDGAVAELASKIDELESDAGGGQVIKDPGAEMDSGTLKSNGKDCGTVKDRIENRENRGGSDVKFTYRPSVPAHRALKESPLSSDNIFKQSHAGLFNLCIVVLVAVNSRLIIENIMKYGWLIKTGFWFSSRSLRDWPLLMCCLTLPIFSLAAYLVEKLACRKYISAPTVVFLHILFSSTAVLYPVSVILSCESAVLSGVALMLFACIVWLKLVSYAHTNFDMRAIANSVDKGDALSNASSAESSHDVSFKSLVYFMVAPTLCYQPSYPRTASIRKGWVVRQFVKLIIFTGFMGFIIEQYINPIVQNSQHPLKGDLLYAIERVLKLSVPNLYVWLCMFYCFFHLWLNILAELLRFGDREFYKDWWNARTVEEYWRMWNMPVHKWMVRHIYFPCLRHKIPRGVALLITFFVSAVFHELCIAVPCHIFKLWAFIGIMFQIPLVGITNYLQNKFRSSMVGNMIFWFIFCILGQPMCLLLYYHDLMNRKGTTESR

SEQ ID NO: 69 - protein, 388 aa, Homo sapiens
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 70 - protein, 345 aa, Arachis hypogaea
MEVSGAVLRNVTCPSFSVHVSSRRRGGDSCVTVPVRMRKKAVVRCCCGFSDSGHVQYYGDEKKKENGTAMLSTKKKLKMLKKRVLFDDLQGNLTWDAAMVLMKQLEQVRAEEKELKKKRKQEKKEAKLKASKMNTNPDCESSSSSSSSESESESSESECDNEVVDMKKNIKVGVAVAVADSPRKAETMILYTSLVARDVSANHHHHNAVELFSRNNDISVGSINGGLKNENTAVITTEAIPQKRIEVCMGNKCKKSGSIALLQEFERVVGAEGGAAAAVVGCKCMGKCKSAPNVRIQNSTADKIAEGFNDSVKVPANPLCIGVAWRMLKPLWLRFLGENQESTNE

SEQ ID NO: 71 - protein, 520 aa, Arabidopsis thaliana
MAILDSAGVTTVTENGGGEFVDLDRLRRRKSRSDSSNGLLLSGSDNNSPSDDVGAPADVRDRIDSVVNDDAQGTANLAGDNNGGGDNNGGGRGGGEGRGNADATFTYRPSVPAHRRARESPLSSDAIFKQSHAGLFNLCVVVLIAVNSRLIIENLMKYGWLIRTDFWFSSRSLRDWPLFMCCISLSIFPLAAFTVEKLVLQKYISEPVVIFLHIIITMTEVLYPVYVTLRCDSAFLSGVTLMLLTCIVWLKLVSYAHTSYDIRSLANAADKANPEVSYYVSLKSLAYFMVAPTLCYQPSYPRSACIRKGWVARQFAKLVIFTGFMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHIYFPCLRSKIPKTLAIIIAFLVSAVFHELCIAVPCRLFKLWAFLGIMFQVPLVFITNYLQERFGSTVGNMIFWFIFCIFGQPMCVLLYYHDLMNRKGSMS

SEQ ID NO: 72 - protein, 593 aa, Thraustochytrium aureum
MEPIAYKEGGLPPRADGKRASSGNVRATNGAAGGPRLGPVSPRKGRNQGSFDSGEATPNGMTTPSQGSVSSYSSEDAHTNGGGGSPRSSGSAGSGGANGGLKLRAPRGGPVPSRRSAAPPARHRLTREEREMFLRIEREWREEDEWAKQEPGVVSTMIWTPILIGLRCFNIWLSVVTWPLSFLARVVFGMEMKKASFWDVPLERRKQTVAVAGFVMLLPCVLLAYVWSLVLLVFPLTTLPMLGYYIWIFKIDKSPENGQRTPFLRYWSAWRHFASYFPLRLIKTHNLDPSRKYVFAYHPHGIISIGAFGNFATNATGFSRKFPGIDLRLLTLEMNFWCPWIREFLLSMGVCSAAKRSCNKILSKGPGSAIMLVVGGAAESLDTEPGTYRLTLGRKGFIRVALDNGADLVPVLAFGENDIFDTIYYESGTVMRKIQEVVRKRLGFATPVFSGRGFFNYSFGFLPHRRPVIVVCGRPIKVPKLPEHLRGSALSTTPEGVALVDQYHQKYVAELRRVWDLYKSKWAVSRAESLMIKGVQNPALPRSPSRRIPPAQRVPASAASLSFREVDEAEFEAKEDGATSSPQSMSAALYTEG

SEQ ID NO: 73 - protein, 501 aa, Theobroma cacao
MAISDSPEILGSTATVTSSSHSDSDLNLLSIRRRTSTTAAARAPDRDDSGNGEAVDDRDRVESANLMSNVAENANEMPNSSDTRFTYRPRVPAHRRIKESPLSSGAIFKQSHAGLFNLCIVVLVAVNSRLIIENLMKYGWLIRSGFWFSSRSLSDWPLFMCCLTLPIFPLAAFVVEKLVQRNYISEPVVVFLHAIISTTAVLYPVIVNLRCDSAFLSGVALMLFACIVWLKLVSYAHTNNDMRALAKSAEKGDVDPSYDVSFKSLAYFMVAPTLCYQQSYPRTPAVRKSWVVRQFIKLIVFTGLMGFIIEQYINPIVQNSQHPLKGNLLYAIERVLKLSVPNLYVWLCMFYCFFHLWLNILAELLRFGDREFYKDWWNAKTVEEYWRMWNMPVHKWMVRHIYFPCLRNGIPKGVAIVIAFLVSAVFHELCIAVPCHMFKLWAFIGIMFQVPLVLITNYLQDKFRSSMVGNMIFWFIFSILGQPMCVLLYYHDLMNRKGKAD

SEQ ID NO: 74 - protein, 146 aa, Rattus norvegicus
MKVLLLLAVVIMAFGSIQVQGSLLEFGQMILFKTGKRADVSYGFYGCHCGVGGRGSPKDATDWCCVTHDCCYNRLEKRGCGTKFLTYKFSYRGGQISCSTNQDSCRKQLCQCDKAAAECFARNKKSYSLKYQFYPNKFCKGKTPSC

SEQ ID NO: 75 - protein, 137 aa, Rattus norvegicus
MKRLLTLAWFLACSVPAVPGGLLELKSMIEKVTGKNAVKNYGFYGCYCGWGGHGTPKDGTDWCCRMHDRCYGLLEEKHCAIRTQSYDYRFTQDLVICEHDSFCPVRLCACDRKLVYCLRRNLWSYNRLYQYYPNFLC

SEQ ID NO: 76 - protein, 137 aa, Mus musculus
MKGLLTLAWFLACSVPAVPGGLLELKSMIEKVTGKNAFKNYGFYGCYCGWGGRGTPKDGTDWCCQMHDRCYGQLEEKDCAIRTQSYDYRYTNGLVICEHDSFCPMRLCACDRKLVYCLRRNLWTYNPLYQYYPNFLC

SEQ ID NO: 77 - protein, 142 aa, Mus musculus
MKPPIALACLCLLVPLAGGNLVQFGVMIERMTGKPALQYNDYGCYCGVGGSHWPVDETDWCCHAHDCCYGRLEKLGCDPKLEKYLFSITRDNIFCAGRTACQRHTCECDKRAALCFRHNLNTYNRKYAHYPNKLCTGPTPPC

SEQ ID NO: 78 - protein, 148 aa, Arabidopsis thaliana
MAAPIILFSFLLFFSVSVSALNVGVQLIHPSISLTKECSRKCESEFCSVPPFLRYGKYCGLLYSGCPGERPCDGLDSCCMKHDACVQSKNNDYLSQECSQKFINCMNNFSQKKQPTFKGNKCDADEVIDVISIVMEAALIAGKVLKKP

SEQ ID NO: 79 - protein, 486 aa, Mus musculus
MFPRETKWNISFAGCGFLGVYHIGVASCLREHAPFLVANATHIYGASAGALTATALVTGACLGEAGANIIEVSKEARKRFLGPLHPSFNLVKTIRGCLLKTLPADCHERANGRLGISLTRVSDGENVIISHFSSKDELIQANVCSTFIPVYCGLIPPTLQGVRYVDGGISDNLPLYELKNTITVSPFSGESDICPQDSSTNIHELRVTNTSIQFNLRNLYRLSKALFPPEPMVLREMCKQGYRDGLRFLRRNGLLNQPNPLLALPPVVPQEEDAEEAAVVEERAGEEDQLQPYRKDRILEHLPARLNEALLEACVEPKDLMTTLSNMLPVRLATAMMVPYTLPLESAVSFTIRLLEWLPDVPEDIRWMKEQTGSICQYLVMRAKRKLGDHLPSRLSEQVELRRAQSLPSVPLSCATYSEALPNWVRNNLSLGDALAKWEECQRQLLLGLFCTNVAFPPDALRMRAPASPTAADPATPQDPPGLPPC

SEQ ID NO: 80 - protein, 371 aa, Cocos nucifera
MVELRSSSSEMDLDRPNIEEYLTTDSIQESPKKLHLRDLLDISPTLTEATGAIVDDSFTRCFKSNPPEPWNWNVYLFPLWCLGVIIRYGILFPLRVAILTAGWLVFFAAFIPVHFLLTAHNKWRRKIERKLVEMICSVFVASWTGVVKYHGPRPSMRPQQVFVANHTSMIDFIILEQMTAFAVIMQKHPGWVGFIQKTILEGVGCIWFNRTESKDREVVARKLREHIHGADNNPLLIFPEGTCVNNHYTVMFKKGAFELGCAVCPVAIKYNKIFVDAFWNSKKQSFTMHLFHLMTSWAVVCDVWYLEPQYIRPGETPIEFAERVRDMISVRAGLKKVPWDGYLKYFRPSPKLTERKQQIFAESVLQRLEEK

SEQ ID NO: 81 - protein, 825 aa, Bos taurus
MDESALTLGTIDVSYLPNSSEYSIGRCKHATEEWGECGSRPTVFRSATLKWKESLMSRKRPFVGRCCYSCTPQSWDKFFNPSIPSLGLRNVIYINETHTRHRGWLARRLSYVLFIQERDVHKGMFATNVTENVLNSSRVQEAIAEVAGELNPDGSAQQQSKAVNKVKKKARKILQEMVATVSPAMIRLTGWVLLKLFNSFFWNIQIHKGQLEMVKAATETNLPLIFLPVHRSHIDYLLLTFILFCHNIKAPYIASGNNLNIPIFSTLIHKLGGFFIRRRLDETPDGRKDILYRALLHGHIVELLRQQQFLEIFLEGTRSRSGKISCARAGLLSVVVDTLSTNTIPDILIIPGGISYDRIIEGHYNGEQLGKPKKNESLWSIARGVIRMLRKNYGCVKTDFAQPFSLKEYLESQSQKPVSAPLSLEQALLPAILPSRPSGAADEGTDMSINESRNATDESRRRLIAHLAEHILFTASKSCAIMSTHIVACLLLYRHRQGIGLFTLVEDFFVMKEEVLARDFDLGFSGNSEDVVMHAIQFLGNCITITHTSKNDEFFITPSTTIPSVFELNFYSNGVLHVFIMEAIIACSLYAVLKKRGPGGPASPSLVSQEQLVHKAASLCYLLSNEGTISLPCQTFYQICHETVGRFIQYGILIVAEQDDQEDISPGLAEQQWDKKLPEPLSWRSDEEDEDSDFGEEQRDCYLKVSQSKEHQQFITFLQRLLGPLLEAYSSAAVFIHNFGGPVPEPEFLQKLHKYLITRTERRVAVYAESATYCLVKNAVKTFKDIGVFKETKQKRVSGLELSNTFLPQCNRQKLLEYILSLVVL

SEQ ID NO: 82 - protein, 410 aa, Cocos nucifera
CPCGIYTSRTKAVVEAVESKAAEWRSAMKRAVLASDTGAEEEVGHARPILRARSEEELLSYIRKEVETGRLSSDIANGLEELYYNYRNAVLQSGDPRANKIILSNMAVAFDRILLDVEDPFTFSPYHQAIREPFDYYMFGQNYIRPLIDFRRSYIGNISIFSDMERKLQQGHNIVLMSNHQTEADPAVIALLLERTNSHIAETMVFVAGDRVVTDPLCKPFSMGRNLLCVYSKKHMDDAPELIEMKRKANTRSLKEMALLLRGGSQTIWIAPSGGRDRPDPNTGEWHPAPFDVSSVDNMRRLVEHSSVPGHIYPLSLLCYEVMPPPSQVEKQIGERRTISFHGVGLSVAPELNFNEVTAGRETPEQAKEAFSQALYNSVGEQYNVLKSAIYEHQGLNASNSIISLSQPCQ

SEQ ID NO: 83 - protein, 488 aa, Cocos nucifera
MASASHGGKERRSIACEFEGALLISRRLFAYFMLAALEAGGPIRALTLFLIFPLLWLLELAGLERMALQLMIFVSTAGLRVDDLKDVAKATLPRFYLEDLSQRAYQVFSSYEGKKYVVSCIPRIMVEPFLKEFLDVDHVIGTELKMFRDCSAGLVASPGVMVGARQLEAVLSIMEDAEVISVGLGSGLRDQTFMFLCRQERGPIPPEENSSPLRRKNYPKPLMFHDGRLVAHPTPLDFLAVILWLPLGVLSAVSRILLGILLPYKMGLVASAVTGFRIRAQFPKAQHAINTPASVGTPSRRGTLYVCNHRTLLDPVMISTAIQRKLTAVTYSLSRFSEVISPIPTIRLTRDRFKDGATMRSLLGHGDLVVCPEGTTCREPYLLRFSPLFAEIADNIIPVAVTAEGSMFYGTTVRGHKWLDSLFFLMNPRPCYQLRFLESITRDQRSSYEIANGIQQLIGQAIGFECTNFTRRDKYQMLAGHDGADTRR

SEQ ID NO: 84 - protein, 437 aa, Cocos nucifera
RTLVFDVEGGLLRSSSTFPYFMLVALEAGGFLRGLLLLLLYPLLCCFGHEVGLRVMATVCFFGIRKEGLRVGRAVQPKFFLEDLGLEGFEVLRRARRRVCYTRMPRVMVEGFLKEYLGVEVVVGRELKEFGGYYTGLMEEEGEVDLERTVLFGEEDTSEGSFGIGSLPRGRYPKPLVFHDGRVAFRPTPANTLLMFLWLPLGVPLSIFRSSIFLLLPYRISIPIGAFSGMKSRLISPPTFNTQRPPLSARGHLYVCNHRTLLDPIYISAALNRLVTAVTYSVSPISEALSPIRTVRLTRDKEEDRRRMARLLTQGDLVVCPEGTTCREPYLLRFSSLFTELTDTAIPVALVSRVSMFYGTTASGYKFLDPIYFLANPCPQYDVEFLENVSTNTIDGKSCSSHEVANHVQHKIGDALGFECTKLTRKDKYMMLAGNEG

SEQ ID NO: 85 - protein, 472 aa, Cocos nucifera
GRDGHTVVADMDGTLLRGRSSFPYFALVAFEIGGILRLLFLLLASPIAGILYYFVSESAGIKVLIFATLSGVRVGDLESVARAVLPKFYSMDLHPESWRVFSACGKRCVLTANPRIMVEAFLKEYLGADMVIGTEIATYKGRATGFVCHPGVLVGANKAAALRKVFGEVSPEIGLGDRKTDFAFMNLCQVSASIPHKPDREAVARDKLPKPIVFHDGRLVQKPTPLLALLIILWIPVGFLLACLRIAAGALLPMRLVYHAFWALGIRITVRGVPPPPAEKSLARSGVLFICSHRTLLDPIFLSAALGRPIAAVTYSVSRLSEFLSPIKTVRLTRDRARDAAMIKKLLEEGDLVVCPEGTTCREPFLLRFSALFAELTDQIVPVAMANRMSMFHGTTARGWKGMDPFYFFMNPSPAYEVMFLNKLPPELTCSAGKSSHDVANYTQRLIAATLSYQCTSFTRKDKYKALAGNDG

SEQ ID NO: 86 - protein, 308 aa, Cocos nucifera
MDASGASSFLRGRCLESCFKASFGMSQPKDAAGQPSRRPADADDFVDDDRWITVILSVVRIAACFLSMMVTTIVWNMIMLILLPWPYARIRQGNLYGHVTGRMLMWILGNPITIEGSEFSNTRAIYICNHASLVDIFLIMWLIPKGTVTIAKKEIIWYPLFGQLYVLANHQRIDRSNPSAAIESIKEVARAVVKKNLSLIIFPEGTRSKTGRLLPFKKGFIHIALQTRLPIVPMVLTGTHLAWRKNSLRVRPAPITVKYFSPIKTDDWEEEKINHYVEMIHALYVDHLPESQKPLVSKGRDASGRSNS

SEQ ID NO: 87 - protein, 384 aa, Cuphea viscosissima
MAIAAAAVIFLFGLIFFASGLIINLFQALCFVLIRPLSKNAYRRINRVFAELLLSELLCLFDWWAGAKLKLFTDPETFRLMGKEHALVIINHMTELDWMVGWVMGQHFGCLGSIISVAKKSTKFLPVLGWSMWFSEYLYLERSWAKDKSTLKSHIERLIDYPLPFWLVIFVEGTRFTRTKLLAAQQYAVSSGLPVPRNVLIPRTKGFVSCVSHMRSFVPAVYDVTVAFPKTSPPPTLLNLFEGQSIMLHVHIKRHAMKDLPESDDAVAEWCRDKFVEKDALLDKHNAEDTFSGQEVRHTGSRQLKSLLVVISWVVVTTFGALKFLQWSSWKGKAFSAIGLGIVTLLMHVLILSSQAERSNPAEVAQAKLKTGLSISKKVTDKEN

SEQ ID NO: 88 - protein, 387 aa, Cuphea avigera var. pulcherrima
MTIASAAVVFLFGILLFTSGLIINLFQAFCSVLVWPLSKNAYRRINRVFAEFLPLEFLWLFHWWAGAKLKLFTDPETFRLMGKEHALVIINHKIELDWMVGWVLGQHLGCLGSILSVAKKSTKFLPVFGWSLWFSEYLFLERNWAKDKKTLKSHIERLKDYPLPFWLIIFVEGTRFTRTKLLAAQQYAASAGLPVPRNVLIPHTKGFVSSVSHMRSFVPAIYDVTVAFPKTSPPPTMLKLFEGHSVELHVHIKRHAMKDLPESEDAVAQWCRDKFVEKDALLDKHNAEDTFSGQEVHHVGRPIKSLLVVISWVVVIIFGALKFLQWSSLLSSWKGKAFSVIGLGTVALLMQILILSSQAERSIPAKETPANLKTELSSSKKVTNKEN

SEQ ID NO: 89 - protein, 308 aa, Cuphea avigera var. pulcherrima
MASIGISSLLKNRKLESSFSTGFAKDSFPHSPEKTMIRDDSEHRTIIADGLSVDDDDGWMAVLISWARLVMCFVLVLITTSIWTLIMVILIPWPCERIKQSNVFGHVSGRMLMWLLGNPVKIEGAEHANERAIYICNHASPLDIVLTMWLTPKGTVCIAKKEIVWYPLIGQLYALAGHLRIDRSNPVAAIQSMKEVARAVVKNDLSLIIFPEGTRSKDGRLLPFKKGFVHLALQTRRPIVPIVLTGTHMAWRKGSLHIRPTPLTVKYLPPIVTTDWTPDRVEDYTKMIHDIYVNHLPESQQPLRPKES

SEQ ID NO: 90 - protein, 399 aa, Cocos nucifera
MNGSSSNEGKLLNGNQKQMEDFELLNSKNGPKHCPLTPLRVFRGVLCLVILLLTAFMMLIYWAPVTCLLLRLFSVHYSRKATSILFGTWLSLWPFLFEKINKTKVVFSGDIVPEKERVLLFANHRTEVDWMYLWDLALRKGRLGYIKYILKSSLMKLPIFSWGFHILEFIPVERKWEVDEAIMWKKLSAFKDPQDPLWLAVFPEGTDYTEQKCIKSQQFAAENGLPILRNVLLPKTKGFNSCLEALRNSLDAVYDITIGYKHRCPLFIDNVFGVDPSEVHIHVQRILPHEIPTSENEVTAWLMERFRLKDQQLSDFLTLGYFPHQGTEGDLSTPTCLVKCFAVITSTVIFIYLTLFSSVLFKIYVSLSFTYLSFVTYFGIHPQPVLGYVKGLFCGKKVC

SEQ ID NO: 91 - protein, 305 aa, Cocos nucifera
WLRGRRLESCLEASVRSRGPAKRRPEDAVGQRSPRPAAAADFVDDDRWITVILSVVRIVVCFLSMAATTAVWAVIMLLLLPWPYARIRQGNLYGHVTGRMLMWILGNPITIEGSEFSNTRAIYICNHASPVDIFLVMWLTPTGTVGIAKKEIIWYPLFGQLYVLANHLRIDRSNPTAAIESIKEVARMVVQKNLSLIIFPEGTRSKTGRLLPFKKGFVHIALQTRLPIVPMVLTGTHLAWRKNSLRVRPAPLTVKYLPPIKTDDWEAEKIDDYVEMIHALFVDHLPESQKPLVSEGRDVNKRSNS

SEQ ID NO: 92 - protein, 387 aa, Cocos nucifera
MSSELKDLGRSNGSIDSQEESPRVGGGGGSSGKAKDERPLLKPGSAASEAAGAATPSESLEELEKKYAPYVRKDAYGTMGRGELPPVEKVLLGIALVTLVPIRLVVGIVVVVLYYLICRLCTLFYPPNPEDGKDDYAHMVGWRRVVVVRTGRFLSRVLLFVLGFYWIRESHRSFSAEDEREQPGESKRPEVIVSNHISYVDILYQMSSYFPSFVAKICSKCLGCLYVQRESKSSKGVSGLLTERIQEAHQNKLYPMMMLFPEGTTTNGNYLLPFKTGAFLAKAPVLPVILKYPYNRFSPAWDTISGVRHVFLLLCQFVNHLEAIHLPVYYPSEQEKDDPKLYANNVRKLMATEANLMLSDIGLAEKRIYHAVLNGNSLPRVLHQKDD

SEQ ID NO: 93 - protein, 400 aa, Cocos nucifera
MASELKDLGGSNGSLVSQEESPRVGGSGGSSGKAKDERPLLKPGSTASDGDGAARFSESIEELEKKYAPYVRKDVYGTMGRGELPAAEKVLRGIALVTLVPIRLVVGLFLLLLYYLICRLCTLFYAPNQEDGREDYADMVGWRREVVVRTGRFLSRLMLFVLGFYWIRESRRSVSVEDEHTEQSNESESPGVIVSNHISYVDILYHMSSYFPSFVAKNRNNGFIFAFICSKCLGCVYVQRESKSSEFKGVSGLLTERIKKAHQNKLYPMMLLFPEGTTTNGDYLLPFKTGAFLAKEPVLPVILKYPYNRFSPAWDTISGVRHVFLLLCQFVNHIEVIRLPVYYPSEQEKEDPKLYASNVRKLMATEGNLILSDIGLSEKRVYHAALNGNSLPRVLHQKDD

SEQ ID NO: 94 - protein, 294 aa, Cocos nucifera
MEDPNGDLRTPLLPGGCDSDVILDIDRERRPAGEPGNPFEFLGAPPLVLPRPIPVDPFRNHTPSIAGIYEWFKVVLCVPIALARLVLFGLALAVGFVATKLALEGWKDKQSPMPRWRSRIMWITRISARCILFTFGYHWIKRIGRPASREVAPIVVANHISYVEPIFFFYELFPTIVASESHDALPFVGTIIRAMQVVIYVDRFSAPSRKHAVSEIKRKASCNGFPRVLLFPEGTTTNGRFLISFQLGAFIHGFPVQPVVVRFPHVHFDQSWGNISLMKLMFRMFTQFHNFMEV

SEQ ID NO: 95 - protein, 493 aa, Cuphea avigera var. pulcherrima
MHEAVSHFLHRHAPLSLSGFAMAIVSGTLGVAASSFIPDSDHSTTSPSLRKRNSSSLFPKASDTSSVDGKAAHRTSSPVHLKLAESPLSSRNIFKQNHEGLFNLCMVTLVAVIIRLFLENLLKYGWLMKRDFWLSTFTAWPLFICSLGLPIFPLAAFVVEKLAQKNLLPEPIVLCSHVIITSASVLYPALVILRFDCALMSGIGLMLYSCALWLKLVSYAHTSYDMRCEAKSRLEGKSSADSKNGELPYRVNIKDLAYFMVAPTLCYQLSYPRTQFIRKFWVARQVLKLILVNVVMGFIIEQYMIPVMHNSKPPRRGYWLHFIERNLKLAVPSIGLWFCIFYSIFHLWLNIVAELLRFGDREFYKDWWNAKNMEEYWKMWNIPVHRWMVRHLYGPCMKRKLPRWVAISISFLLSAVLHEICVSVPCHVFQLWAFNGMMLQIPLVLSSKPLQKRFPSSKAGNVFFWFLFCIYGQPNCVLMYYHALMERRGLRID

SEQ ID NO: 96 - protein, 512 aa, Elaeis guineensis
MAVSKNPETLAPDQEPSKESDLRRRPASSPSSTAASPAVPDSSSRTSSSITGSWTTALDGDSGAGAVRIGDPKDRIGEANDIGEKKKACSGEVPVGFVDRPSAPVHVRVVESPLSSDTIFQQSHAGLLNLCVVVLIAVNSRLIIENLMKYGLLIGSGFFFSSRLLRDWPLLICSLTLPVFPLGSYMVEKLAYKKFISEPVVVSLHVILIIATIMYPVFVILRCDSPILSGINLMLFVSSICLKLVSYAHANYDLRSSSNSIDKGIHKSQGVSFKSLVYFIMAPTLCYQPSYPRTTCIRKGWVICQLVKLVIFTGVMGFIIEQYIDPIIKNSQHPLKGNVLNAMERVLKLSIPTLYVWLCVFYCTFHLWLNILAELLCFGDREFYKDWWNAKTIEEYWRMWNMPVHKWMLRHVYLPCIRNGIPKGVAMVISFFISAIFHELCIGIPCHIFKFWAFIGIMFQVPLVILTKYLQNKFKSAMVGNMIFWFFFSIYGQPMCVLLYYHDVMNRKVGTE

SEQ ID NO: 97 - protein, 489 aa, Bos taurus
MGDRGGAGGSRRRRTGSRPSIQGGSGPAAAEEEVRDVGAGGDAPVRDTDKDGDVDVGSGHWDLRCHRLQDSLFSSDSGFSNYRGILNWCVVMLILSNARLFLENLIKYGILVDPIQVVSLFLKDPYSWPALCLVIVANIFAVAAFQVEKRLAVGALTEQAGLLLHGVNLATILCFPAAVAFLLESITPVGSVLALMVYTILFLKLFSYRDVNLWCRERRAGAKAKAALAGKAANGGAAQRTVSYPDNLTYRDLYYFLFAPTLCYELNFPRSPRIRKRFLLRRLLEMLFLTQLQVGLIQQWMVPAIQNSMKPFKDMDYSRIVERLLKLAVPNHLIWLIFFYWLFHSCLNAVAELMQFGDREFYRDWWNSESITYFWQNWNIPVHKWCIRHFYKPMLRRGSSKWAARTAVFLASAFFHEYLVSIPLRMFRLWAFTGMMAQIPLAWIVGRFFRGNYGNAAVWLSLIIGQPVAVLMYVHDYYVLNREAPAAGT

SEQ ID NO: 98 - protein, 482 aa, Capra hircus
MGPLRPNLVPQAYRRLLGLESESLAPGLCVHSCAPLASAGKLSGRLGAEGLLPGTPRCHRLQDSLFSSDSGFSNYRGILNWCVVMLILSNARLFLENLIKYGILVDPIQVVSLFLKDPYSWPALCLVIVANIFAVAAFQVEKRLAVGALTEQAGLLLHGVNLATILCFPAAVAFLLESITPVGSVLALMVYTILFLKLFSYRDVNLWCRERRAGAKAKAALAGKKANGGAAQRTVSYPDNLTYRDLYYFLFAPTLCYELNFPRSPRIRKRFLLRRLLEMLFLTQLQVGLIQQWMVPAIQNSMKPFKDMDYSRIVERLLKLAVPNHLIWLIFFYWLFHSCLNAVAELMQFGDREFYRDWWNSESITYFWQNWNIPVHKWCLRHFYKPMLRRGSSKWAARTGVFLASAFFHEYLVSIPLRMFRLWAFTGMMAQIPLAWIVGRFFRGNYGNAAVWLSLIIGQPVAVLMYVHDYYVLNREAPTAGT

SEQ ID NO: 99 - protein, 402 aa, Cocos nucifera
MAVSKNPETLAPDQEPSKASDLRRRLASSAVPDSSSRTSSSITESWTTALGEDSGAGAVRIGDPKDQIGEANDIGEKKKACLGDRVGRDEVPVGFVDRPSAPVHVRAVESPLSSDTIFQQSHAGLFNLCVVVLIAVNSRLIIENLMKYGLLIGSGFFFSSRLLRDWPLLICSLTLPVFPLGAYMVEKLAYKKFISEPVVVSLHVILVIGTIMYPVFIILRCDSTVLSGLNLMLFASSICLKLVSYAHANYDLRSSSNSIDKGIHKSQGVSFKSLVYFIMAPTLCYQPSYPQTICIRKGWVICQLVKLVIFTGVMGFIIEQYIDPIIKNSQHPLKGNVLYAMERVLKLSIPTLYVWLCLFYCTFHLWLNILAELLHFGDREFYKDWWNAKTIEEYWRMWNMMK

SEQ ID NO: 100 - protein, 363 aa, Euonymus alatus
MMDAHQEIKNFIKVWVQAMVCLSYAYYFSSRLPKGLLRLLSLLPVLYLLLIAPLNISSFILSSITGFFLAWLTTFKVISFAFDQGPLYPLPQNLLHFISIACLPITIKRNPSPKLKSTTNPSPISHLLKKAFMSFPSKVLFHWVIAHLYQYKKYMDPNVVLVIYCCHVYVMLDISLSLCATLAEFLCGFDVEPQFKEPYLATSLQDFWGRRWNIIVSSVLRSTVYAPTRNIASYLIGSRWAYFPAIIATFVVSGVMHDVVYYVYMMHMYPKWDMTGHFVLHGICEALEVEMKCKRSRSDKWRRHPAVDWVMVMGFVMGTSVSLLFVPLLRDNVDQIVAEEYSILFNFVREKIVMLGTRFVCGN

SEQ ID NO: 101 - protein, 498 aa, Cocos nucifera
HRDRTLMAIPSDRETLERAPEPSPALDLQSSLRRRLQSTAAAVVVTDSSSKTSFTSVENLITDSGEDSGVDTSSDAHTRDRVVDGVDREEENKTVSVLNCKQYEDGGGRGEGQGTGGGVPAKFFYRASAPAHRKVKESPLSSDAIFKQSHAGLLNLCIVVLIAVNSRLIIENLMKYGLLIRAGYWFSSKSLRDWPLLMCSLTLPAFPLGAFMVEKLAQHKFISEPVSSNMMYILSRCDSAVLSGIALMLFASVVWLKLVSYAHTNYDMRKLSKSIDKEDMYSNCPEIGNLKGVSFKSLAYFMVAPTLCYQPNYPRTTCIRKGWVIRQLVKLVIFTGLVGFIIEQLSVPTLYVWLCMFYCFFHLWLNILAELLCFGDREFYKDWWNAKTIEEYWRMWNMPVHRWMIRHIYFPCIRNGICVAVPCHIFKFWAFIGIMFQQIPLVTLTKYLQHKFRNSMVCSNLLGQVGNMIFWFFFSILGQPMCVLLYYHDVMNRKVRTE

SEQ ID NO: 102 - protein, 358 aa, Cocos nucifera
MPRVTSSGDIYSAAHRSIRRSLSLSHEASRRMDQANGDRQPAVLDNPTGAGEAAVYRGTEYSVVRTIVALALWLGLIHFNVALVLTALLLLPARLAAASVHLPYLFMAIPLDETNGWGRKLSRWICKYAVGYFPVTLYVEDIKVFDPNQYAVFAFEPHSVLPIGVVALADLTGFMPLTKVKVLASSAVFYTPFLRHLWTWLGLVSASRKNFYVYLEAGYSCIVVPGGVQEMLHMDHDSEVVAFLKARKGFVRIAMETGRPIVPVFCFGQSYVYKWWKPPGKLFVWIARAIKFTPIVFWGRFGSPIPFRHPMHVVVGKPIELKRNPKPTIEEINEVHARFVAAFQELFEKHKARAGYPD

SEQ ID NO: 103 - protein, 504 aa, Cocos nucifera
MAIPSDQETLEGAPEPSPGSDLHSSLRRRLHSAASAVVVQNSSSKTSLPRAEDLTTDSGEDSGVDTSSDADTRDRVVDGVDREEEKKAGSVLNGGQYDDGAGRAKGQEAGVGVPAKFLYRPSAPAHQKVKESPLSSDAIFKQSHAGLFNLCIVVLIAVNSRLVVQHLLQYGLLIRAGFWFSSKSLTDWPLLMCSLTLSAFPLGAFMVEKLAQHKFISEPVRCDSAVLSSIALMLFASVVWLKLVSYAHTNYDMRTLSRSIDKEDMYSSCIEIDNMKGFSFKSLAYFMVAPTLCYQPSYPRTTCIRKGWVIRQLVKLVAFTGLMGFIIEQYINPIVQNSQHPLKGNFLNAIERVLKLSVPTLYVWLCMFYCFFHLWLNILAELLRFGDREFYKDWWNAKTIEEYWRMWNMPVHRWMIRHVYFPCLRNGLSKVMQICIAVPCHIFKFWAFIGIMFQIPLVILTKYLHCKFRNSMVMIFWFFFSILGQPMCVLLYYHDVMNRKVRSE

SEQ ID NO: 104 - protein, 364 aa, Cocos nucifera
MEISGAALRRVPGISCAGFRRDAGEPSFSGASIVAGRGRFGVKISSWPRRVRGGGRFSDEGHLCYYATPVRCGGGRKEEKRRARLMESLARDLSAFYSVGFGVEAGQGVVGDVKAKMITEAADVLLAQLNQLRAGEKDMERKRKEEKKEMKRKRKEKKAAMKAARLKDRADLDASSSSSESSNGDSETVVKMSSLRTATFPHHRLKSLEVPKEAPKCDEDPITLALRAVERMEENRTHLKPEQECSSSSSSSSSSCDISCKCSDMVVEKPMDRIEVCVGGKCKKSGSLELLGELERKVGVEGVVVGCKCMGKCKDGPNVRVSDRGLDFVKPAGNPLFIGVGLEDVGTILAEFFGEKKDVGLVAA

SEQ ID NO: 105 - protein, 309 aa, Amycolatopsis mediterranei
MSALTSQPTSSGSSEKIPRLRGWRAKAAGVVLAALALTTGVAAPAPAAANPYERGPDPTTASIEATSGSFATSTVTVSRLAVSGFGGGTIYYPTTTTAGTFGALSIAPGFTATQSSIAWLGPRLASQGFVVFTIDTLTTSDQPDSRGRQLLASLDYLTQQSSVRSRIDSTRLGVVGHSMGGGGTLEAARSRPTLQAAVPLTAWDLTKNWSTLQVPTLVVGAQSDTVAPVASHSIPFYTSLPSTLDRAYLELRGASHFAPNSPNTTIAKYTLSWLKRFIDNDTRYEQFLCPIPSTSLSISDYRGNCPHNG

SEQ ID NO: 106 - protein, 364 aa, Burkholderia cepacia
MARTMRSRVVAGAVACAMSIAPFAGTTAVMTLATTHAAMAPTAPAAGYAATRYPIILEHGLSGTDKYAGVLEYWYGIQQDLQQNGAAVYVANLSGFQSDDGPNGRGEQLLAYVKTVLAATGATKVNLVGHSQGGLSSRYVAAVAPDLVASVTTIGTPHRGSEFADFVQDVLAYDPTGLSSSVIAAFVNVFGILTSSSHNTNQDALAALQTLTTARAATYNQNYPSAGLGAPGSCQTGAPTETVGGNTHLLYSWAGTAIQPTLSVFGVTGATDTSTLPLVDPANVLDLSTLALFGTGTVMINRGSGQNDGLVSKCSALYGKVLSTSYKWNHLDEINQLLGVRGAYAEDPVAVIRTHANRLKLAGV

SEQ ID NO: 107 - protein, 317 aa, Psychrobacter sp.
MLLKRLCLAAVFSLSMVGCTTAPNQLAVNTTQKIIQYERNKSDLDIKALTLASGDKMVYADNGNVAGEPLLLIHGFGGNKDNFTRIARQLEGYHLIIPDLLGFGESSKPMSADYRSEAQATRLHELLQAKGLASNIHISGNSMGGAISVAYAAKYLKDVKSLWLVDSAGFWSAGIPKSLEGATLENNPLLIKSNEDFYKMYDFVMYKPPYLPKSVKAVFAQERIKNKELDAKILEQIVTDNVEERAKIIAQYNIPTLVVWGDKDQIIKPETVNLIKKIIPQAQVIRMPEIGHVPMIEAVEQTADDYKAFRRILEAQR

SEQ ID NO: 108 - protein, 448 aa, Blastobotrys adeninivorans
MLKLLLLVAQLVAFVFGAALPEERVYARDAVTPPSEDPFYTPDDGYEKEEPGTILRWRHAPQMPAFTVFKQNLNASIQILYRTTDTQGQPTATVVTVMIPHNHAEGKLLSYQSWEDSAWINCAPSYAIQFGANPQGIISQVDMLTLQSALNEGWIVSTPDYEGPKSSFTSAIISGQATLDSIRAVLKSESFTGVKPDSKVAMWGYSGGSIASGWAAALQPTYAPELKIAGAALGGVIQNITSVAVQVNKGPFVGLVPAGIKGLSSQYPELEDYINDQLLPDKRDDFEKAGKQCLSVDVLTYAFQDWFSYTKAGDRVLYNETIQKVLDENAMGKQKPQIPLLFYHGVHDEVMPIADVDKLYYEYCSNGVTVEYYREEGSEHVLEMITGFPKAYNYVKNLLDGGSVSSGCQRHDVFSNAFDEDALPTYSAEIWGILKGLLGAPVGPAAIS

SEQ ID NO: 109 - protein, 417 aa, Geobacillus stearothermophilus
MMKGCRVMVVLLGLCFVFGLSVPGGRTEAASLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDSHWLENDGIVNTISMNGPKRGSNDRIVPYDGTLKKGVWNDMGTYNVDHLEIIGVDPNPSFDIRAFYLRLAEQLASLQP

SEQ ID NO: 110 - protein, 614 aa, Serratia marcescens
MGIFSYKDLDENASKALFSDALAISTYAYHNIDNGFDEGYHQTGFGLGLPLTLITALIGSTQSQGGLPRIPWNPDSEQAAQETVNNAGWSVISAAQLGYAGKTDARGTYYGETAGYTTAQAEVLGKYDSEGNLTAIGISFRGTSGPRESLIGDTIGDVINDLLAGFGPKGYADGYTLNAFGNLLGDVAKFAQAHGLSGEDVVVSGHSLGGLAVNSMAAQSDANWGGFYAQSNYVAFASPTQYEAGGKVINIGYENDPVFRALDGTSLTLPSLGVHDAPHASATNNIVNFNDHYASDAWNLLPFSILNIPTWLSHLPFFYQDGLMRVLNSEFYSLTDKDSTIIVSNLSNVTRGNTWVEDLNRNAETHSGPTFIIGSDGNDLIKGGKGNDYLEGRDGDDIFRDAGGYNLIAGGKGHNIFDTQQALKNTEVAYDGNTLYLRDAKGGITLADDISTLRSKETSWLIFSKEVDHQVTAAGLKSDSGLKAYAAATTGGDGDDVLQARSHDAWLFGNAGNDTLIGHAGGNLTFVGGSGDDILKGAGNGNTFLFSGDFGRDQLYGFNATDKLVFIGTEGASGNIRDYATQQNDDLVLAFGHGQVTLIGVSLDHFNTDRVVLA

SEQ ID NO: 111 - protein, 563 aa, Geotrichum candidum
MVSKSFFLAAAVNVVGVLAQAPTAVLNDNEVITGVLEGQVDTFKGIPFADPPVADLRFKHPQSFTGSYQGLQAKDFSSACMQIDPYNSLTILDNVLNLGKIIPEDFRGPIYDMAKGTVSMSEDCLYLNVFRPAGTKPSDKLPVMVWIYGGAFIYGSSAAYPGNGYVKESVKMGQPVVFVSINYRTGPFGFLGGDGITAEGNTNSGLHDQRKGLEWVSDNIANFGGDPDKVMIFGESAGAMSVGHQLIAYGGDNTYNGKPLFHSAILQSGGPLPYYDSTSVGPEKAYNRFAEYAGCDTTASDVDILQCLRSKSSQVLHDAQNSYDLKDLFGLLPEFLGFGPRPDGDILPGSAFELYRSGRYAKVPYITGNQEDEGTVLAPVALNATTTPHVKKWLQYIFNQASDSSIERVLELYPQTLSEGSPFRTGILNALTPQFKRVAAILSDLLFQSPRRIMLNATKDVNRWTYISTHLHNLVPFLGTFHGNELVIQFNVNVGPADSYLRYFISFANHHDPNVGTNLLTWNKYTDEGKEMLEIKMFDNSMRTDDFRIEGISNFESDVNLYG

SEQ ID NO: 112 - protein, 333 aa, Fusarium vanettenii
MMLILSILSIIAFAAASPVPSIDENIRVLEHRAVTVTTQDLSNFRFYLQHADAAYCNFNTAVGKPVHCGAGNCPDVEKDSAIVVGSVVGTKTGIGAYVATDNARKEIVVSVRGSINVRNWITNFNFGQKTCDLVAGCGVHTGFLEAWEEVAANIKAAVSAAKTANPTFKFVVTGHSLGGAVATVAAAYLRKDGFPFDLYTYGSPRVGNDFFANFVTQQTGAEYRVTHGDDPVPRLPPIVFGYRHTSPEYWLDGGPLDKDYTVSEIKVCDGIANVMCNGGTIGLDILAHITYFQSMATCAPIAIPWKRDMSDEELDKKLTQYSEMDQEFVKQMT

SEQ ID NO: 113 - protein, 214 aa, Bacillus amyloliquefaciens
MKQIKSKIIAILTVCMLSVISVFAFQPTVSKASSEHNPVVMVHGIGGASFNFAGIKTYLASQGWSRNEMAAIDFLDKTGNNRHNAPRLSTYVKKVLSETGAKKVDIVAHSMGGANTLYYIKNLDGGDKIANVVTLGGANGLVTNRALPGTDPNQKILYTSIYSAADLIVLNPLSRLIGGKNVQIHGVGHIGLLMMSQVNGLIKEGLNGGGQNTN

SEQ ID NO: 114 - protein, 304 aa, Malassezia globosa
MLFSRFVLLAFGSVAAVSASSIYARGRGGSSTDQPVANPYNTKEISLAAGLVQQTYCDSTENGLKIGDSELLYTMGEGYARQRVNIYHSPSLGIAVAIEGTNLFSLNSDLHDAKFAQEDPNERYIQYYPKGTKLMHGFQQAYNDLMDDIFTAVKKYKKEKNEKRVTVIGHSLGAAMGLLCAMDIELRMDGGLYKTYLFGLPRLGNPTFASFVDQKIGDKFHSIINGRDWVPTVPPRALGYQHPSDYVWIYPGNSTSAKLYPGQENVHGILTVAREFNFDDHQGIYFHTQIGAVMGECPAQVGAH

SEQ ID NO: 115 - protein, 615 aa, Serratia liquefaciens
MGIFNYQGLDEAKSKTLFTDAMAISTYAYHNIDNGFDEGYHSSGFGLGLPFTLVTALIGSTQSQGGLPGIPWNPDSEQAALAAVNNAGWSLISADQLGYQGKTDARGTYYGETFGYTTAQAEVLGKYDSEGNLTGIGIAFRGTSGPRESLITDTIGDLVNDLLAGFGPNGYADNYSLKAFGTLLEDVAKFAQAHGLSGDDITISGHSLGGLAVNSMAALSDGNWGGFYAQSNYVAFASPTQYETGGKVINVGYENDPVFRALDGTTRTSATLGVHDAPQDSATNNIVNFNDHYASAAWNILPFSILNIPTWLSHLPFFYQDGLMRVLNSEFYSLTSKDSTVIVSNLSDVTRGNTWVEDLNRNAEQHSGPTFIVGSDGNDLIKGGTGNDYLEGRAGNDTFRDDGGFNIISGGEGHNTLDLQHALKNTEVAYDGNTLYLRDADGGITLANSIGTLKSKESSLLIFTKEVDHQVTDNGLLSTKGLTAYASSANGTAADDVLTAKESGSWLFGLEGNDQLFGGKGNDVFVGGAGNDVMHSQGGSNTFLFSGDFGQDLIYGYQAQDKLVFIGTEGSSSGGNYRDFVSEVNDNLVFNFGGSTVTLVGIGFDSLSDGQVVLA

SEQ ID NO: 116 - protein, 548 aa, Diutina rugosa
MKLCLLALGAAVAAAPTATLANGDTITGLNAIVNEKFLGIPFAEPPVGTLRFKPPVPYSASLNGQQFTSYGPSCMQMNPMGSFEDTLPKNARHLVLQSKIFQVVLPNDEDCLTINVIRPPGTRASAGLPVMLWIFGGGFELGGSSLFPGDQMVAKSVLMGKPVIHVSMNYRVASWGFLAGPDIQNEGSGNAGLHDQRLAMQWVADNIAGFGGDPSKVTIYGESAGSMSTFVHLVWNDGDNTYNGKPLFRAAIMQSGCMVPSDPVDGTYGTEIYNQVVASAGCGSASDKLACLRGLSQDTLYQATSDTPGVLAYPSLRLSYLPRPDGTFITDDMYALVRDGKYAHVPVIIGDQNDEGTLFGLSSLNVTTDAQARAYFKQSFIHASDAEIDTLMAAYTSDITQGSPFDTGIFNAITPQFKRISALLGDLAFTLARRYFLNYYQGGTKYSFLSKQLSGLPVLGTFHGNDIIWQDYLVGSGSVIYNNAFIAFANDLDPNKAGLWTNWPTYTSSSQSGNNLMQINGLGLYTGKDNFRPDAYSALFSNPPSFFV

SEQ ID NO: 117 - protein, 664 aa, Arabidopsis thaliana
MEGIDHLADERNKAEFDVEDMKIVWAGSRHAFEVSDRIARLVASDPVFEKSNRARLSRKELFKSTLRKCAHAFKRIIELRLNEEEAGRLRHFIDQPAYVDLHWGMFVPAIKGQGTEEQQKKWLSLANKMQIIGCYAQTELGHGSNVQGLETTATFDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGEYVPSDVPKQLVYGTMVYVRQTIVADASNALSRAVCIATRYSAVRRQFGAHNGGIETQVIDYKTQQNRLFPLLASAYAFRFVGEWLKWLYTDVTERLAASDFATLPEAHACTAGLKSLTTTATADGIEECRKLCGGHGYLWCSGLPELFAVYVPACTYEGDNVVLQLQVARFLMKTVAQLGSGKVPVGTTAYMGRAAHLLQCRSGVQKAEDWLNPDVVLEAFEARALRMAVTCAKNLSKFENQEQGFQELLADLVEAAIAHCQLIVVSKFIAKLEQDIGGKGVKKQLNNLCYIYALYLLHKHLGDFLSTNCITPKQASLANDQLRSLYTQVRPNAVALVDAFNYTDHYLNSVLGRYDGNVYPKLFEEALKDPLNDSVVPDGYQEYLRPVLQQQLRTARL

SEQ ID NO: 118 - protein, 651 aa, Arabidopsis thaliana
MEGIDHLADERNKAEFDVEDMKIVWAGSRHAFEVFEKSNRARLSRKELFKSTLRKCAHAFKRIIELRLNEEEAGRLRHFIDQPAYVDLHWGMFVPAIKGQGTEEQQKKWLSLANKMQIIGCYAQTELGHGSNVQGLETTATFDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGEYVPSDVPKQLVYGTMVYVRQTIVADASNALSRAVCIATRYSAVRRQFGAHNGGIETQVIDYKTQQNRLFPLLASAYAFRFVGEWLKWLYTDVTERLAASDFATLPEAHACTAGLKSLTTTATADGIEECRKLCGGHGYLWCSGLPELFAVYVPACTYEGDNVVLQLQVARFLMKTVAQLGSGKVPVGTTAYMGRAAHLLQCRSGVQKAEDWLNPDVVLEAFEARALRMAVTCAKNLSKFENQEQGFQELLADLVEAAIAHCQLIVVSKFIAKLEQDIGGKGVKKQLNNLCYIYALYLLHKHLGDFLSTNCITPKQASLANDQLRSLYTQVRPNAVALVDAFNYTDHYLNSVLGRYDGNVYPKLFEEALKDPLNDSVVPDGYQEYLRPVLQQQLRTARL

SEQ ID NO: 119 - protein, 692 aa, Arabidopsis thaliana
MESRREKNPMTEEESDGLIAARRIQRLSLHLSPSLTPSPSLPLVQTETCSARSKKLDVNGEALSLYMRGKHIDIQEKIFDFFNSRPDLQTPIEISKDDHRELCMNQLIGLVREAGVRPFRYVADDPEKYFAIMEAVGSVDMSLGIKMGVQYSLWGGSVINLGTKKHRDKYFDGIDNLDYTGCFAMTELHHGSNVQGLQTTATFDPLKDEFVIDTPNDGAIKWWIGNAAVHGKFATVFARLILPTHDSKGVSDMGVHAFIVPIRDMKTHQTLPGVEIQDCGHKVGLNGVDNGALRFRSVRIPRDNLLNRFGDVSRDGTYTSSLPTINKRFGATLGELVGGRVGLAYASVGVLKISATIAIRYSLLRQQFGPPKQPEVSILDYQSQQHKLMPMLASTYAYHFATVYLVEKYSEMKKTHDEQLVADVHALSAGLKSYVTSYTAKALSVCREACGGHGYAAVNRFGSLRNDHDIFQTFEGDNTVLLQQVAADLLKRYKEKFQGGTLTVTWSYLRESMNTYLSQPNPVTARWEGEDHLRDPKFQLDAFRYRTSRLLQNVAARLQKHSKTLGGFGAWNRCLNHLLTLAESHIETVILAKFIEAVKNCPDPSAKAALKLACDLYALDRIWKDIGTYRNVDYVAPNKAKAIHKLTEYLSFQVRNVAKELVDAFELPDHVTRAPIAMQSDAYSQYTQVVGF

SEQ ID NO: 120 - protein, 646 aa, Arabidopsis thaliana
MESRREKNPMTEEESDGLIAARRIQRLSLHLSPSLTPSPSLPLVQTETCSARSKKLDVNGEALSLYMRGKHIDIQEKIFDFFNSRPDLQTPIEISKDDHRELCMNQLIGLVREAGVRPFRYVADDPEKYFAIMEAVGSVDMSLGIKMGVQYSLWGGSVINLGTKKHRDKYFDGIDNLDYTGCFAMTELHHGSNVQGLQTTATFDPLKDEFVIDTPNDGAIKWWIGNAAVHGKFATVFARLILPTHDSKGVSDMGVHAFIVPIRDMKTHQTLPGVEIQDCGHKVGLNGVDNGALRFRSVRIPRDNLLNRFGDVSRDGTYTSSLPTINKRFGATLGELVGGRVGLAYASVGVLKISATIAIRYSLLRQQFGPPKQPEVSILDYQSQQHKLMPMLASTYAYHFATVYLVEKYSEMKKTHDEQLVADVHALSAGLKSYVTSYTAKALSVCREACGGHGYAAVNRFGSLRNDHDIFQTFEGDNTVLLQQVAADLLKRYKEKFQGGTLTVTWSYLRESMNTYLSQPNPVTARWEGEDHLRDPKFQLDAFRYRTSRLLQNVAARLQKHSKTLGGFGAWNRCLNHLLTLAESHIETVILAKFIEAVKNCPDPSAKAALKLACDLYALDRIWKDIGTYRNVDYVAPNKAKVCFLV

SEQ ID NO: 121 - protein, 675 aa, Arabidopsis thaliana
MSDNRALRRAHVLANHILQSNPPSSNPSLSRELCLQYSPPELNESYGFDVKEMRKLLDGHNVVDRDWIYGLMMQSNLFNRKERGGKIFVSPDYNQTMEQQREITMKRIWYLLENGVFKGWLTETGPEAELRKLALLEVCGIYDHSVSIKVGVHFFLWGNAVKFFGTKRHHEKWLKNTEDYVVKGCFAMTELGHGSNVRGIETVTTYDPKTEEFVINTPCESAQKYWIGGAANHATHTIVFSQLHINGTNQGVHAFIAQIRDQDGSICPNIRIADCGHKIGLNGVDNGRIWFDNLRIPRENLLNAVADVSSDGKYVSSIKDPDQRFGAFMAPLTSGRVTIASSAIYSAKVGLSIAIRYSLSRRAFSVTANGPEVLLLDYPSHQRRLLPLLAKTYAMSFAANELKMIYVKRTPETNKAIHVVSSGFKAVLTWHNMHTLQECREAVGGQGVKTENLVGQLKGEFDVQTTFEGDNNVLMQQVSKALFAEYVSCKKRNKPFKGLGLEHMNSPRPVLPTQLTSSTLRCSQFQTNVFCLRERDLLEQFTSEVAQLQGRGESREFSFLLSHQLAEDLGKAFTEKAILQTILDAEAKLPTGSVKDVLGLVRSMYALISLEEDPSLLRYGYLSQDNVGDVRREVSKLCGELRPHALALVTSFGIPDSFLSPIAFNWVEANAWSSV

SEQ ID NO: 122 - protein, 700 aa, Yarrowia lipolytica
MNPNNTGTIEINGKEYNTFTEPPVAMAQERAKTSFPVREMTYFLDGGEKNTLKNEQIMEEIERDPLFNNDNYYDLNKEQIRELTMERVAKLSLFVRDQPEDDIKKRFALIGIADMGTYTRLGVHYGLFFGAVRGTGTAEQFGHWISKGAGDLRKFYGCFSMTELGHGSNLAGLETTAIYDEETDEFIINTPHIAATKWWIGGAAHTATHTVVFARLIVKGKDYGVKTFVVQLRNINDHSLKVGISIGDIGKKMGRDGIDNGWIQFTNVRIPRQNLLMKYTKVDREGNVTQPPLAQLTYGSLITGRVSMASDSHQVGKRFITIALRYACIRRQFSTTPGQPETKIIDYPYHQRRLLPLLAYVYALKMTADEVGALFSRTMLKMDDLKPDDKAGLNEVVSDVKELFSVSAGLKAFSTWACADVIDKTRQACGGHGYSGYNGFGQAYADWVVQCTWEGDNNILTLSAGRALIQSAVALRKGEPVGNAVSYLKRYKDLANAKLNGRSLTDPKVLVEAWEVAAGNIINRATDQYEKLIGEGLNADQAFEVLSQQRFQAAKVHTRRHLIAAFFSRIDTEAGEAIKQPLLNLALLFALWSIEEDSGLFLREGFLEPKDIDTVTELVNKYCTTVREEVIGYTDAFNLSDYFINAPIGCYDGDAYRHYFQKVNEQNPARDPRPPYYASTLKPFLFREEEDDDICELDEE

SEQ ID NO: 123 - protein, 700 aa, Yarrowia lipolytica
MISPNLTANVEIDGKQYNTFTEPPKALAGERAKVKFPIKDMTEFLHGGEENVTMIERLMTELERDPVLNVSGDYDMPKEQLRETAVARIAALSGHWKKDTEKEALLRSQLHGIVDMGTRIRLGVHTGLFMGAIRGSGTKEQYDYWVRKGAADVKGFYGCFAMTELGHGSNVAGLETTATYIQDTDEFIINTPNTGATKWWIGGAAHSATHTACFARLLVDGKDYGVKIFVVQLRDVSSHSLMPGIALGDIGKKMGRDAIDNGWIQFTNVRIPRQNMLMKYAKVSSTGKVSQPPLAQLTYGALIGGRVTMIADSFFVSQRFITIALRYACVRRQFGTTPGQPETKIIDYPYHQRRLLPLLAFTYAMKMAADQSQIQYDQTTDLLQTIDPKDKGALGKAIVDLKELFASSAGLKAFTTWTCANIIDQCRQACGGHGYSGYNGFGQAYADWVVQCTWEGDNNVLCLSMGRGLIQSCLGHRKGKPLGSSVGYLANKGLEQATLSGRDLKDPKVLIEAWEKVANGAIQRATDKFVELTKGGLSPDQAFEELSQQRFQCAKIHTRKHLVTAFYERINASAKADVKPYLINLANLFTLWSIEEDSGLFLREGFLQPKDIDQVTELVNHYCKEVRDQVAGYTDAFGLSDWFINAPIGNYDGDVYKHYFAKVNQQNPAQNPRPPYYESTLRPFLFREDEDDDICELDEE

SEQ ID NO: 124 - protein, 660 aa, Homo sapiens
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 125 - protein, 665 aa, Glycine max
MEDGVDHLAFERNKAQFDVEDMKIIWAGSRQDFELSDRISRLVASDPAFRKDDRTTLDRKELFKNTLRKAAYAWKRINELRLNEQEAYKLRSFVDQPAFTDLHWGMFVPAIQGQGTDEQQQKWLPLAYRMQIIGCYAQTELGHGSNVQGLETTATFDPKTDEFVIHSPTLTSSKWWPGGLGKISTHAVAYARLIIGGEDHGVHGFIVQLRSLDDHLPLPGITIGDIGMKFGNAAYNTMDNGVLRFDHVRIPRNQMLMRVSQVTREGKYVSSNVPRQLVYGTMVNVRQKIVADASVALSRAVCIATRYSAVRRQFGSHNGGLETQVIDYKTQQARLFPLLASAYAFRFVGGWLKWLYMDVTERLQANDFSTLPEAHACTAGLKSLTTTATADGIEECRKLCGGHGYLCSSGLPELFAVYVPACTYEGDNVVLLLQVARHLMKTVSQLGSGNKPVGTTAYMARVEQLMQYHSDVEKAEDWLKPNVVLEAFEARASRMSVACAQNLSKFANPEEGFQELAADLVDAAVAHCQLIVVSKFIEKLQQDIPGKGVKKQLEVLCSIYALFLLHKHLGDFLSTGCINPKQGSLASEQLRNLYSQVRPNAIALVDAFNYTDHYLGSILGRYDGNVYPKLYEEAWKDPLNDSVVPDGFKEYIQPMLKQQLRNARL

SEQ ID NO: 126 - protein, 703 aa, Paenarthrobacter ureafaciens
MTEVVDRASSPASPGSTTAAADGAKVAVEPRVDVAALGEQLLGRWADIRLHARDLAGREVVQKVEGLTHTEHRSRVFGQLKYLVDNNAVHRAFPSRLGGSDDHGGNIAGFEELVTADPSLQIKAGVQWGLFGSAVMHLGTREHHDKWLPGIMSLEIPGCFAMTETGHGSDVASIATTATYDEETQEFVIDTPFRAAWKDYIGNAANDGLAAVVFAQLITRKVNHGVHAFYVDLRDPATGDFLPGIGGEDDGIKGGLNGIDNGRLHFTNVRIPRTNLLNRYGDVAVDGTYSSTIESPGRRFFTMLGTLVQGRVSLDGAAVAASKVALQSAIHYAAERRQFNATSPTEEEVLLDYQRHQRRLFTRLATTYAASFAHEQLLQKFDDVFSGAHDTDADRQDLETLAAALKPLSTWHALDTLQECREACGGAGFLIENRFASLRADLDVYVTFEGDNTVLLQLVAKRLLADYAKEFRGANFGVLARYVVDQAAGVALHRTGLRQVAQFVADSGSVQKSALALRDEEGQRTLLTDRVQSMVAEVGAALKGAGKLPQHQAAALFNQHQNELIEAAQAHAELLQWEAFTEALAKVDDAGTKEVLTRLRDLFGLSLIEKHLSWYLMNGRLSMQRGRTVGTYINRLLVKIRPHALDLVDAFGYGAEHLRAAIATGAEATRQDEARTYFRQQRASGSAPADEKTLLAIKAGKSR

SEQ ID NO: 127 - protein, 661 aa, Rattus norvegicus
MNPDLRKERASATFNPELITHILDGSPENTRRRREIENLILNDPDFQHEDYNFLTRSQRYEVAVKKSATMVKKMREYGISDPEEIMWFKKLYLANFVEPVGLNYSMFIPTLLNQGTTAQQEKWMRPSQELQIIGTYAQTEMGHGTHLRGLETTATYDPKTQEFILNSPTVTSIKWWPGGLGKTSNHAIVLAQLITQGECYGLHAFVVPIREIGTHKPLPGITVGDIGPKFGYEEMDNGYLKMDNYRIPRENMLMKYAQVKPDGTYVKPLSNKLTYGTMVFVRSFLVGNAAQSLSKACTIAIRYSAVRRQSEIKQSEPEPQILDFQTQQYKLFPLLATAYAFHFVGRYMKETYLRINESIGQGDLSELPELHALTAGLKAFTTWTANAGIEECRMACGGHGYSHSSGIPNIYVTFTPACTFEGENTVMMLQTARFLMKIYDQVRSGKLVGGMVSYLNDLPSQRIQPQQVAVWPTMVDINSLEGLTEAYKLRAARLVEIAAKNLQTHVSHRKSKEVAWNLTSVDLVRASEAHCHYVVVKVFSDKLPKIQDKAVQAVLRNLCLLYSLYGISQKGGDFLEGSIITGAQLSQVNARILELLTLIRPNAVALVDAFDFKDMTLGSVLGRYDGNVYENLFEWAKKSPLNKTEVHESYHKHLKPLQSKL

SEQ ID NO: 128 - protein, 661 aa, Rattus rattus
MNPDLRKERASATFNPELITHILDGSPENTRRRREIENLILNDPDFQHEDYNFLTRSQRYEVAVKKSATMVKKMREYGISDPEEIMWFKNSVHRGHPEPLDLHLGMFLPTLLHQATAEQQERFFMPAWNLEITGTYAQTEMGHGTHLRGLETTATYDPKTQEFILNSPTVTSIKWWPGGLGKTSNHAIVLAQLITQGECYGLHAFVVPIREIGTHKPLPGITVGDIGPKFGYEEMDNGYLKMDNYRIPRENMLMKYAQVKPDGTYVKPLSNKLTYGTMVFVRSFLVGNAAQSLSKACTIAIRYSAVRRQSEIKQSEPEPQILDFQTQQYKLFPLLATAYAFHFVGRYMKETYLRINESIGQGDLSELPELHALTAGLKAFTTWTANAGIEECRMACGGHGYSHSSGIPNIYVTFTPACTFEGENTVMMLQTARFLMKIYDQVRSGKLVGGMVSYLNDLPSQRIQPQQVAVWPTMVDINSLEGLTEAYKLRAARLVEIAAKNLQTHVSHRKSKEVAWNLTSVDLVRASEAHCHYVVVKVFSDKLPKIQDKAVQAVLRNLCLLYSLYGISQKGGDFLEGSIITGAQLSQVNARILELLTLIRPNAVALVDAFDFKDMTLGSVLGRYDGNVYENLFEWAKKSPLNKTEVHESYHKHLKPLQSKL

SEQ ID NO: 129 - protein, 693 aa, Chlamydomonas reinhardtii
MERQDCAGSSSQGPPQGRGGTQPRGIKQLPRFDAGVMETYLDDMRDMKAKVYQMFREHPELLPNVEEGLSKEEHRELVRRSLKVILQAGYSPLDFLARDPRKYFYLGECLSMVDLSLMVKSGVQYSLWGGSVLNLGSEAHRRRYYDDIAQLRLPGCFAMTELKHGSNVAALQTEAVLDVLSDEWVVHTPDEGAIKWWIGNAAEDGRAATVFAREGVQGVGVEDGRAATVFARLKVPDPNGGPKLVDHGVHAFVVPIRDANGSTLPGVEIRDCGYKVGLNGIDNGAIRFTHVRVPRGNLLDRFASVDKSGRYSSPLTSQARRFAATLGELTGGRVGLVAGSVGVLKGAVTIAVRYACLRQQFGPPDCPEVAIIDYQSTQLRLMPILATAYGLHFARGLLTDKYVDMKRTREPRLVEEVHALSAGLKAYTTSYTQAALSTCREACGGHGYAAVNRLGALRSDHDIFQTFEGDNTVLLQQVSAMLLKEYRQQFSGAPLTATYHYLRAALLGALPNNPLVTHDTEPRHLRDPAFLAKALEYRTARMLFTLSLRLRKAGPRLGAFHAWNKCLTHVLDLANAYVESVVYKTFLRAVEGCVDPECRRALKAMSDLFALRLIEGDMMFRNDEYIAPSKAKAISRLVVSLCSELRGVALPLVDAFAIPDHILRAPIGLGGSGGTGPQPDIYKEYLHAAGFEV

SEQ ID NO: 130 - protein, 664 aa, Prunus persica
MEGVDHLAHERSKAQFDVDQMKVVWVGSRHALQVSDRIARLVASDPVLRKDDRTMMTRKELFKNTLRKAAHGWKRINELRLSEEEASWFRHYVDQPAYTDLHWGMFVPFIKGSGTEEQQKKWLPLAYKMQIIGCYAQTELGHGSNVQGLETTATFDPKTDEFVLNSPTLTSSKWWPGGLGKAATHAVAFARLITDGKDHGVNGFIVQLRNLDDHLPLPGITVGDIGMKFGNGAYNSMDNGVLRFDNVRIPRDQMLMRVAQVTREGKYVQSNVPRQLLYGTMVFVRQTIVADASTALSRAVCIATRYSAVRRQFGSENGGVETQVIDYKTQQSRLFPLLASAYAFRFVGEWLKWLYTDVTQKLQANDFSTLPEAHACTAGLKSLTTSATADAIEECRKLCGGHGYLSNSGLPELFAVYVPACTYEGDNIVLLLQVARFLMKTVSQLPSGKKPVGTTSYMGRAEHLIQCRCNVQKVEDWLKPSVILEAFEARAIRMSIACAQDLSKFSNQEEGFAELSSNLAEAAVAHCQLIVVSKFIEKLQQDIPGKGVKEQLQNLCNIYALYIIHKHLGDFLSTGSITAKQASLANDQLRSLYSKLRPNAIALVDAFNYTDHYLGSVLGRYDGDVYPNLYAEAWKDPLNESVVPDGYREYIQPLLKNQLRNARL

SEQ ID NO: 131 - protein, 675 aa, Ctenopseustis herana
MTDSGKVNPDLQRERDNCTFDVTELTNLIDGGVQKTEERRKREEMVLKEGIHIEEVPSVYLSHKDKYELAVKKACYLFKMIRRLQEEENTGMENYQEVLGGSLGSAILGDGSPLTLHYVMFIPTIMGQASVEQQVHWLGRAFNCDIIGTYAQTELGHGTFIRGLETTATYDPSTKEFVLHSPTLTSYKWWPGGLAHTANYCIVVAQLYTNGKCHGIHPFIVQLRDEETHMPLPGIKIGEIGAKLGMNGTNNGFLGFDKVRIPREYMLMKNAKVLEDGTYMNAPSSKLAYGTMMFVRVVLVNDMCCYMAKAVTIATRYSAVRHQSQPKPNEPEPQILEYVTQQHKLIIGIASVHALRLSGTWMWNMYNNVTAELESGDLDRLPELHALSCCLKAVSTADAAECVERCRLSCGGHGYMLASSLPLMYGMVTAACTYEGENTVLHLQTARYLVKAWQQALGGDVLTPTVAYIGKVSNGRRSPPWENTIQGIVLGFQRVAAGKIAQCVANIEKRQKGGMSYEDAWNMTSVQLTAASEAHCRAFILSTYFEETENLVKNVSPALRTVLLQLVDLYVVFWSLQRVGDLLRFTSISERDIEQLQSWYEDLLLKLRVNAVGLVDAFDLKDEILNSALGAYDGRVYERLMDEAMKSPLNAEPVNDSFHKYLKPLMQGKLVPHKL

SEQ ID NO: 132 - protein, 500 aa, Ctenopseustis herana
MCEVNTDLQKERDKCTFDVKALTTFIDGGADRTSERKYREKIMLSEKELTEGVPEEYLSHKERYENGIKKSVILFKLVRQLQEEGRSNITNYREVMNGLLGTSNTRDGSPLGLHYIMFMPAIINQGSEEQQAQWLPRAWNCSILGSYAQTELGHGTFIRGLETTATYDPETKEFELHSPTLTSYKWWPGGLGQTCNYCIVVAQLYTKGQCHGIHSFIIQVRDEETHMPLPGIKVGDIGAKLGLNSVNNGFLGFEHLRIPREQMLMKHAQVLEDGTYVKSKSSKLNYGAMVFVRVVIVYDMVNYLSRAVTIATRYSAVRRQSQLRPGEPEPQIIDYVTQQHKIFIGIAACHALRLTANMLWETFHDVSEQLVGGNLQRLPELHALACCLKAVSTADTAMYVERCRLACGGHGYMHSSNLPMTYGLVTAACTYEGENTVLLLQTARYLVKTWQAIDSTDMAQIPTVAYMKAASAAGFCARWENSVEGVIRGLQKVAMGKVST

SEQ ID NO: 133 - protein, 672 aa, Ctenopseustis herana
  misc_feature (651)..(651): Xaa can be any naturally occurring amino acid
MGVNKKVNEDLQKERDKCNFNVAELTRFLDGSDKLTKKRKEIENRVLSVEGLIDAVPDEYMSHKERYENAVRKSVIMHQTLGNLEDKTLSVVESARFALRSTITSAIFKDNSPLMLHYSMFTNVVEGQGDEEQKKYWLPKIKNMEIIGTYAQTELGHGTFIRGLETIAEYDPKTEEFVLNSPKLTAYKWWPGGLAHTANHCVVMAHTYSQGKSCGIQPFVVQIRDLETHMPMKGVKLGEIGAKLGFNTVNNGFLGFEHHRIPRDKMLMKNSQIMRDGTFRTGPNSKLTYGTMVYIRVSILGSMANALGKAVTIATRYAAVRRQSQPKPNEPEPQILDYVTQQHKLFIGIATSHAYYVSCFWLWTLYSQVNKELAAGNLDNLAELHALVCCLKATTSADAAVLTERCRLACGGHGYMLSSNLPQTYANVTAANTYEGENTVMHLQTARALVKAGMQVAQGQKVSPSMEYLADQSKIAKWDNSVDGIVKGFQKVAAGKVAACLASLQKHTNNGQSSEDAWNLTSVQLVAASEAHARLILVSVFKSQMDATTFTLSGETRTVLSQLVELYVVYWALEKVGDLLLYTPITGMDVQELQQTYEGLLAKIRPNAVGLVDAFDFRDEVLNSALGAYDGRVYERLMDEAMKSPLNAEPXNDSFHKYLKPLMQGKLVPHKL

SEQ ID NO: 134 - protein, 686 aa, Ctenopseustis herana
MEDLSFVPDLPSGPLDAYRSAASFDWKRLKLALEGDIENLRLKYKIWHTLEKDPLFSHHSVTPPTEEQKRLTQLQVLRINQYKFLSDDVFRSSYSKKTRALMSLNEAVQSLNPSVSVKMAIGIYLISNALLSLGTERHYKFYEATLIKREILACFALTEVAHGSDARLMRTTATYDAKTKEFVIHSPDFEAAKCWLGNLGRTCTHGLLFAQLITPDGTNHGLHGFVVPIRDPATLETYPGLIVGDMGEKIGVHGIDNGFMMFNQYRIPRENLLNRSADVTEEGVYESKFSEPSRILGSALENLSAGRIGIMQESCHSISSAVCIAIRYAATRQQFGTAAQEIPLIEYQLHQWRLFGFVAAAVVFKLYIQNMTQVYLKVVESSNAGLKLDNLSETVSEIHAMVSSSKPMTTWTVLRAAQQCREACGGHGFLKRANLGDIRSNHEVTVTYEGDNSVLSQQAGNWLLRQFECARAGQPVDSPLGTVAFLPRWQAILATKFSCQGTGELKNTEFILSTYRWLLCWLLKETHEQYESLIASGLTKFQAKAKTQVYKWQTLTEVYAEYLALIFSLESITRKEKELQPILQKQFLLYGLWCLDRHLVELYQGGFAAGEGLAKLVRQAVLELCSDVKGEVVSIVDALGPTDFVLNSVIGKSDGKLYQNLQKELFHNPGAMQRASWWREVVPSKL

SEQ ID NO: 135 - protein, 697 aa, Ctenopseustis herana
MEVKEIPPASDEELKSCFSDLPSGPLDIYRKKASFDWRRMKLAYDSLNTIKTKNKVWNFMESHALFKHPEATPTLDEQRQIATKRMYVIHNVDFVPLEEIADDPRLFQSFTEAIFMFDSSLAVKLSLTFRMFANTIRGSGREHHFHLIEDNDNGKIGGCFALTEIAHGSNAKGMRTTATYNVEEKCFVMHTPDFEAAKCWVGSMGKCATHAIVYAKLISKGKNHGLHSFVVPIRDPRTLKPFAGITVGDIGEKVGLNGIDNGFLMFNKYRLPKEALLDKLGGVDDNGDYKTPFKDPSKRFGAALGILSGGRVHITSISTNYLQKAIVIAVRYSAVRRQFGPENATEETPVLEYQQQQIRLLPYLAATYAMRVFCNWFGAMHVAMTINSMLGADDNAAARGIEMHALSSAVKPVCGWTARDGIQNCRECCGGHGYLKASAIGDLRNDNDANCTYEGENSMLLQQTSNWLLNVWAKRATPGFADTPFGSIEFLNGAQGLLAGKCQWNSVKEIVQPANVVHMYKWLTAYMVKLTAEKVAQLKSQGKDSYEAKNDSQSYNAVTLSAVYGENFIVNHFYKAALAFKDAACRAVLLKLVSLYGSFLLEKHMATLYIGGFFSAEQGLLLREGILSLCAELTPEAVALVDTLAPPDWCLKSVLGQADGEAYKHIQDSIMTYPGSMTRPEWWRDVVHWETYVPAKL

SEQ ID NO: 136 - protein, 668 aa, Epiphyas postvittana
  misc_feature (622)..(622): Xaa can be any naturally occurring amino acid
MKEVNKDLQNERDKCTFDVKALTIFIDGGPEKTSERKYRGKIMLGEKELTEGVPEEYMSHKERYDDGIRKSVIVFRLVRQLQEEGRSNITNYRDVMNGLLGSSSMKDGSALGLHYIMFMPAIINQGSEDQQARWLPRAWNCSIIGSYAQTELGHGTFIRGLETTATYDPQTKEFELHSPTLTSYKWWPGGVGHTANYCIVVAQLYTRGQCHGIHSFIIQVRDEETHMPLPGIKVGDIGAKLGLNSVNNGFLSFDHLRIPRDQMLMKHAQVLEDGTYVRSKSSKLNYGAMVFVRVVIVYDMVNYLSRAVTIATRYSAVRRQSQLRPGEPEPQILDYVTQQHKIFIGIAACHALRLTANMLWETFHAVTEQLGGGNLQRLPELHALACCLKAVSTADTAMYVERCRLACGGHGYMHSSNLPMTYGTVTAACTYEGENTVLLLQTARYLVKTWQAIDTTDTALTPTVAYLKEASTADFCSRWDNSVEGIIRGFQKVAMGKVSTCVKNLNKRAKSGMGPEDAWNHTSVQLVSAAEAHCRVIILSTFFDDISKLPDTVPADVTLVLRQLVELYAFYWALEKLNDLLLYTCMSEADVDELQYRYEELLRRVRPNAVGLVDAFDIIDGXLQSTLGAFDGRVYERLMEEAMKSPLNARPVQDSFHKYLKPFMRGKL

SEQ ID NO: 137 - protein, 671 aa, Epiphyas postvittana
MGVYKTNEDLQKERDKCTFDVAEITRFIDGSDRVTQKRRDKESRVLSVEGLRDAVPDEYMSHKERYENAVRKAVIMHQTLGNLEDNTLTPFESARLYLRTTISSAIFKDNSPLMLHYSMFTNVIEGQADQQQQAYWLKKIKNMEIIGTYAQTELGHGTFIRGLELTAEYDPKTEEFVLNSPKLTAYKWWPGGLAHTANHCVVMAHTYSQGKSCGIQPFIVQIRDLETHMPMKGVKLGEIGAKLGFNTVNNGFLGFENHRIPRDRMLMKNSQILKDGTFLSSPNSKLTYGTMVYIRVSILGSMANALGKAVTIATRYAAVRRQSQPKPNEPEPQILDYVTQQHKLFIGIASSHAYYVSCFWLYTLYSRVNKELAAGNMDNLAELHALTCCLKATTSADAAVLVERCRLACGGHGYMLSSNLPQTYANVTAANTYEGENTVMLLQTARALVKAGMQVAQGQKVSPSMAYLADQSKMAKWDNSVDGIVRGFQKVAAGKVAACLASLQKHTSNGQSAEDAWNLTSVQLVAASEAHARLILLSVFKSEMDVQTVTLSGETRAVLSQLVQLYVVYWALEKVGDLLLFTPISGKDVQELQQTYEGLLAKIRPNAVGLVDAFDFRDEVLNSALGAFDGRVYERLMDEAMKSPLNAEPVNESFHKYLKPLMQGKLVSHKL

SEQ ID NO: 138 - protein, 686 aa, SEQ ID NO: 139
MEDLSFVPDLPSGPLDAYRSAASFDWKRLKLALEDDIENLRLKYKVWKVLEKDPLFAHHSVTPSTEEQKRITQLQLIRINQYKFLTDDVFKSSYIKKTQALMTLNEAIQSWNPSVSVKMAIGIYLISNALLSLGTERHYKFYEAMLIKREILACFALTEVAHGSDARLMRTTATYDAATREFVINSPDFEAAKCWVGNLGRTCTHGLVFAQLITPGGTNHGLHGFVVPIRDPATLETYPGLVVGDMGEKIGVHGIDNGFLMFNQYRIPRENLLNRSADVTEEGVYESKFSEPSKILGAALENLSAGRIGIMQESCNSISNAVCIAVRYAATRQQFGTAAQEIPLIDYQLHQWRLFGFVAAAVVFKLYIRNMGQVYLKVVQSSNSGEKLDNLSETVSEIHAMVSSSKPMMTWTVLRAAQQCREACGGHGFLKRANLGDIRSNHEVTVTYEGDNSVLSQQAGNWLLRQYESARAAQPVDSPLGTVAFLSSWQTILDSRFRGQGTEELKSTEFILSTYRWLLCWLLKETNDQYESLIASGLTKFQAKAKSQVYKWQTLTQVYAEYLAIIFSLESIGRKEQGLKPMLEKQFLLYGLWSLDRHLVELYQGGFAQGEALAKLLRQAILELCSDVKSEVVAIVDALGPTDFVLNSVLGKSDGKLYQNLQKEFFHNPGAMQRASWWREVIPSKL

SEQ ID NO: 139 - protein, 697 aa, Epiphyas postvittana
MEVKEIQPASDEELKRFFPDLPSGPLDSFRKKASFDWRRMKLAYDSKNTINTKNKVWSFMESHPLFKHTEATPTLDEQRHIATKRMYVIHNIDFVPLEEIADDPRLFQAFTEAIFMFDSSLAVKLSLTFRMFANTIRGSGRDHHFHLIEANDNGKIGGCFALTEIAHGSNAKGMRTTATYDVEGRCFIMHTPDFEAAKCWVGSMGKCATHAIVYAKLISKGKNHGLHSFVVPIRDPQTLKPFAGITVGDIGEKVGLNGIDNGFLMFNKYRLPKEALLDKLGGVDENGDYKTPFKDPSKRFGAALGILSGGRVHITSISTNYLQKAIVIAIRYSAVRRQFGPENATEETPVLEYQQQQIRLLPYLAATYAMRVFCNWFGAMHVTMTVNSMLGVDDNAAARGIEMHALSSAVKPVTGWAARDGIQNCRECCGGHGYLKAAAIGDLRNDNDANCTYEGENSMLLQQTSNWLLNVWAKRAAPGFADTPFGSIEFLNGAQALLAGRCQWNNVKDIVQPANVVHMYKWLTAYMVKLTAEKVAQLKSQGKDSYEAKNDSQSYNAVTLSVVYGENFIVNHFYKSALAFEDKACKAVLLKLVSLYGAFLLEKHMATLYIGGFFSGEQGLLLREGILTLCAELTPEAVALADTLAPPDWCLKSVLGQADGEAYKHIQDSIMTYPGSMTRPEWWRDVVHWETYVPAKL

SEQ ID NO: 140 - protein, 673 aa, Planotortrix excessana
MCEVNIDLQKERDKCTFDVQALTTFVDGGAHRTLERKYREKIMLSEKELMEGVPEEYLSHKERYENGIKKSVILFKLVRQLQEEGRSNITNYREVMNGLLGTSNTRDGSPLGLHYIMFMPAIINQGSEEQQAQWLPRAWNCSILGSYAQTELGHGTFIRGLETTATYDPKTKEFELHSPTLTSYKWWPGGLGQTVNYCIVVAQLYTKGQCHGIHSFIIQVRDEETHLPLPGIKVGDIGSKLGLNSVNNGFLGFEHLRIPREQMLMKHAQVLEDGTYVRSKNSKLNYGAMVFVRVVIVYDMVNYLSRAVTIATRYSAVRRQSQLRPGEPELQIIDYVTQQHKIFIGIAACHALRLTANMLWETFHDVSEQLVGGNLQRLPELHALACCLKAVSTADTAMYVERCRLACGGHGYMHSSNLPMTYGLVTAACTYEGENTVLLLQTARYLVKTWQAIESTDMAQIPTVAYMKAASAADFCARWENSVEGIIRGLQKVAMGKVATCVNNIKKRVDSGMTPEDAWNVTSVQLVSAAEVHCRVIIVSTFYDEILKLTNTVPSDVRLVLRQLVELYALYWALEKLNDLLLYTCMSEPDVDDLQFRYEELLNTVRPNAVGLVDGFDIVDGILQSTLGAYDGRVYERLMDEAMKSPLNAEPVNQSFHKYLKPLMQGKLVPHKL

SEQ ID NO: 141 - protein, 672 aa, Planotortrix excessana
MGVNKKVNEDLQNERNKCNFNVAELTQFLDGSDKLTKKRKEIENRVLSVEGLIDVVPDEYMSHKERYENAVRKSVIMHQTLGNLEDKTLSVVESARFALRSTISSAIFKDNSPLMLHYSMFTNVIEGQGDEEQQKYWMKKIKNMEIIGTYAQTELGHGTFIRGLETMAEYDPKTEEFVLNSPKLTAYKWWPGGLAHTANHCVVMAHTYSQGKSCGIQPFIVQIRDLETHMPMKGVKLGEIGAKLGFNTVNNGFLGFENHRIPRDKMLMKYSQIMRDGTFKTGPNSKLTYGTMVYIRVSILGSMANALGKAVTIATRYAAVRRQSQPKPNEPEPQILDYVTQQHKLFIGIASAHAYYVSCFWLWTLYSRVNKELAAGNLDNLAELHALACCLKATTSADAAVLVERCRLACGGHGYMLSSNLPQTYANVTAANTYEGENTVLLLQTARALVKAGMQVAQGQKVSPSMEYLADQSKMSKWDNSVDGIVKGFQKVAAGKVAACLASLQKHTNNGQSAEDAWNLTSVQLVAASEAHARLILLSVFKSQMDATTFTLSGETRTVLSQLVELYVVYWALEKVGDLLLYTPISGKDVQELQQTYEGLLAKIRPNAVGLVDAFDFRDEVLNSALGAYDGRVYERLMAEAMKSPLNAEPVNQSFHKYLKPLMQGKLVPHKL

SEQ ID NO: 142 - protein, 686 aa, Planotortrix excessana
MEDLSFVPDLPTGPLDAYRSAASFDWKRLKLALEGDIENLRLKYKVWQTLEKDPLFAHHSVTPSTEEQKRITQLQLLRINQYKFLSDEVFRSSYSKKTRALMSLNEAVQSLNPSVSVKMAIGIYLISNALLSLGTERHYKFYEATLIKREILACFALTEVAHGSDARLMRTTATYDAKTKEFVIHSPDFEAAKCWLGNLGRTCTHGLLFAQLITPDGTNHGLHGFVVPIRDPATLETYPGLIVGDMGEKIGVHGIDNGFMMFNQYRIPRENLLNRSADVTEEGVYESKFSEPSRILGSALENLSAGRIGIMQESCHSISSAVCIAVRYAATRQQFGTAAQEIPLIEYQLHQWRLFGFVAAAVVFKLYIQNMTQVYLKVVESSNAGLKLDNLSETVSEIHAMVSSSKPMTTWTVLRAAQQCREACGGHGFLKRANLGDIRSNHEVTVTYEGDNSVLSQQAGNWLLRQFECARAGQPVDSPLGTVAFLPRWEAILADRFNCRGTEELKNTEFILSTYRWLLCWLLKETHEQYEALMASGLTKFQAKAKSQVYKWQTLTEVYAEYLALIFSLESIGRKEKELQPMLVKQFLLYGLWCLDRHLVELYQGGFAQGEGLAKLVRQAVLELCSDVKGEVVSIVDALGPTDFVLNSVIGKSDGKLYQNLQKELFHNPGAMQRAAWWREVVPSKL

SEQ ID NO: 143 - protein, 697 aa, Planotortrix excessana
MEVKEIPLASDEELKSCFPDLPSGPLDIFRKKASFDWRRMKLAYDSINTIKTKNKVWNFMETHPLFKHPEATPTLDEQRQIATKRMYVIHNVDFVPLEEIADDPRLFQSFTEAIFMFDSSLAVKLSLTFRMFANTIRGSGREHHFHLIEDNDNGKIGGCFALTEIAHGSNAKGMRTTATYDVEERCFVMHTPDFEAAKCWVGSMGKCATHAIVYAKLISKGKNHGLHSFVVPIRDTRTLKPFAGITVGDIGEKVGLNGIDNGFLMFNKYRMPKEALLDKLGGVDDNGDYKTPFKDPSKRFGAALGILSGGRVHITSISTNYLQKAIVIAIRYSAVRRQFGPENATEETPVLEYQQQQIRLLPYLAATYAMRVFCNWFGAMHVTMTINSMMGVDDNAAARGIEMHALSSAVKPVCGWTARDGIQNCRECCGGHGYLKAAAIGDLRNDNDANCTYEGENSMLLQQTSNWLLNVWAKRATPGFADTPFGSIEFLNGAQGLLAEKCKWNSVKEIVQPANVVHMYKWLTAYMVKLTAEKVAQLKSQGKDSYEAKNDSQSYNAVTLSAVYGENFIVNHFYKAALATKDAACKAVLLKLVSLYGSFLLEKHMATLYIGGFFKAEQGLLLREGILSLCAELTPEAVALVDTLAPPDWCLKSVLGQADGEAYKHIQDSIMTYPGSMTRPEWWRDVVHWETYVPAKL

SEQ ID NO: 144 - protein, 665 aa, Cocos nucifera
MEEVDHLAHERIKAQFDVDAMKVVWAGSKHALDVADRMARLVASDPVFRKDNRPMLARKELFKNTLKKAAHAWKRINELRLTEEEASTLRVLVDEPSYVDLHWGMFVPAIKGQGTDKQQKKWLPLAYKMQIIGCYAQTELGHGSNVQGLETTATFDPKTDEFIIHSPTLTSSKWWPGGLGKVSTHAVVYAHLITEGKDHGVHGFIVQLRSLDNHSPLPGITIGDIGTKFGNGAYNTMDNGVLRFDHVRIPRSQMLMRVSQVTREGKFIVSDVPRQLVYGTMVYVRQTIVSDASRALSRAVCIAVRYSAVRRQFGSQDGGPETQVVIDYKTQQSRLFPLLASAYAFRFVGEWLKWLYADVTQRLQANDFSTLPEAHACTAGLKSLTTSATADGIEECRKLCGGHGYLCSSGLPELFAVYVPTCTYEGDNVVLLLQVARFLMKTVSQLGSGKQPVGTTAYMGRAHHLMQYKCDVRGAEDWLKPSVILQAFEARAVRLAVNCAQNISKAPSPEEGFSELSADLVEAAVAHCQLIVVSKFIKKVQQDIPGLGVKEQLQILCNIYALSVLHKHLGEFLATGCITPRQGSLANDQLRYLYSQVRPNAVALVDAFNYTDHYLGSVLGRYDGNVYPKLEEEAWKDPLNDSVVPDGYHEYIQPVLKQKFRLSRL

SEQ ID NO: 145 - protein, 664 aa, Cocos nucifera
MEEVDHLAHERSKAQFDVDAMKVVWAGSKHALDVSDRMARLVASDPVFRKDNRTMLGRKELFKNTLRKAAHAWKRVHELRLTEEEASMLRLFLDEPSYVDLHWGMFVPAIKGQGTDEQQKKWLPLAYKMQIIGCYAQTELGHGSNVQGLETTATFDPKSDEFIIHSPTLTSSKWWPGGLGKVSTHAVVYARLITDGKDHGINGFIVQLRSLDDHSPLPGIIIGDIGTKFGNGAYNTMDNGVLRFDHVRIPRNQMLMRVSQVTREGKYLQSDVPRQLLYGTMVYVRQTIVSDASKALSRAVCIAVRYSAVRRQFGSQDGGPETQVIDYKTQQSRLFPLLASAYAFRFVGEWLKWLYADVTQRLQANDFSTLPEAHACTAGLKSLTTSATADGIEECRKLCGGHGYLCSSGLPELFAVYVPACTYEGDNVVLLLQVARFLMKTVSQLGSGKQPVGATAYMGKAQHLMQCKCDVRGAEDWLKPSIILEAFEARAVRLAVNCAQNISKAASPEEGFSELSADLLEAAVAHCQLIIVSKFIEKVQQDVPGHGVKEQLQILCNIYAISVLHKHVGDFLATGCITPKQASLANDQLRSLYSQVRPNAVVLVDAFNYTDHYLGSVLGRSDGNVYPNLYEEAWKDPLNDSVVPDGYHEYIQPVLKQKFRVSRL

SEQ ID NO: 146 - protein, 2233 aa, Saccharomyces cerevisiae
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 147 - protein, 334 aa, Yarrowia deformans
MKLSTILLTACATLVAALPSPVTPSEAAALQKRVYTSTETSHINQDSYNFFEKYARLANIGYCVGPGTKIFKPFNCGLQCAHFPNVELIQEFHDPRLVFDVSGYLAVDHTSKQIYLVIRGTHSLEDVITDIRILQAPLTNFDFAANISSTATCDDCLVHKGFIESYNNTFNQIGPKLDSVIAEHPDYEIAVTGHSLGGAAALLFGINLKVNGHDPLVVTLGQPIVGNAGFANWVDRLFFGEENPDVSKVTKDRKLYRITHRGDIVPQIPFWDGYQHCSGEVFIDWPLIHPPLSNVVTCEGQRNKQCSAGNTLLQQANVLGNHLQYFVTQGVCGI

SEQ ID NO: 148 - DNA, 927 bp, Artificial sequence
  Gene sequence for Yarrowia lipolytica Lip2 lipase, codon-optimized for expression in Saccharomyces cerevisiae
atggcagttttgcaaaagagagtctatacttctacagaaacctcacatattgatcaagaatcatacaatttctttgaaaagtacgctagattggcaaacatcggttactgcgttggtccaggtacaaagatctttaagcctttcaattgtggtttgcaatgcgctcatttcccaaacgttgaattaatcgaagaatttcacgatcctagattgattttcgacgtatccggttatttggcagttgatcatgccagtaagcaaatctacttggttattagaggtacccactccttagaagatgtcataactgacataagaatcatgcaagctccattgactaattttgatttggccgctaacatatcttcaactgcaacatgtgatgactgcttggttcataacggtttcattcaatcttacaacaacacttacaaccaaatcggtccaaagttggattcagttattgaacaatatcctgactaccaaatagcagttacaggtcattcattgggtggtgcagccgctttgttgttcggtattaatttgaaggttaacggtcacgatccattggttgtcaccttaggtcaacctattgtcggtaatgccggtttcgctaactgggtagacaaattgtttttcggtcaagaaaatccagatgtttccaaagtcagtaaggacagaaagttgtacagaataacacatagaggtgacatagtaccacaagttcctttttgggacggttaccaacattgttccggtgaagttttcatagattggcctttgatccacccacctttaagtaatgtagttatgtgtcaaggtcaatctaataagcaatgctcagctggtaacacattgttgcaacaagtcaacgtaatcggtaaccacttgcaatacttcgtcaccgaaggtgtatgtggtatataa

SEQ ID NO: 149 - DNA, 1353 bp, Artificial sequence
  Gene sequence for the human pancreatic lipase, codon-optimized for expression in Saccharomyces cerevisiae
atgaaagaagtatgttatgaaagattgggttgctttagtgatgactctccatggtcaggtataactgaaagacctttacatatcttgccatggtctcctaaggacgttaacaccagatttttattgtacactaacgaaaaccctaataacttccaagaagttgctgcagattcttcatccataagtggttctaacttcaagactaacagaaagacaagattcattatccacggtttcattgataagggtgaagaaaattggttggctaacgtctgtaagaatttgttcaaggtcgaatctgtaaactgtatttgcgttgattggaagggtggttctagaaccggttacactcaagcctcacaaaacatcagaatcgttggtgccgaagtcgcttacttcgtagaattcttgcaatccgcatttggttactcaccatccaacgtacatgttattggtcacagtttgggtgcccatgccgctggtgaagctggtagaagaacaaatggtaccattggtagaataacaggtttagatccagcagaaccttgttttcaaggtaccccagaattagttagattggacccttccgatgcaaaattcgtcgacgtaattcatacagatggtgccccaatagttcctaatttgggttttggcatgtctcaagttgtcggtcacttggatttctttccaaacggtggtgtagaaatgcctggttgtaaaaagaatatcttgtctcaaatcgttgatattgacggtatatgggaaggtacaagagattttgcagcctgcaaccatttgagatcctacaagtactacactgacagtatcgttaacccagatggttttgctggtttcccttgtgcatcttacaacgtttttactgctaataagtgtttcccatgcccttcaggtggttgcccacaaatgggtcactatgcagacagataccctggtaaaaccaacgatgttggtcaaaagttttatttggacactggtgacgcatctaatttcgccagatggagatacaaagtttctgtcactttgtcaggtaaaaaggttacaggtcatatcttagtctccttgtttggtaataagggtaacagtaagcaatacgaaattttcaaaggtacattaaagccagactccacccacagtaatgaatttgattcagacgtagatgttggtgacttgcaaatggtaaaattcatctggtacaacaacgttattaatccaactttgcctagagtcggtgcttctaaaatcattgttgaaacaaacgtcggtaaacaattcaatttctgttcaccagaaaccgtaagagaagaagttttattgactttgacaccttgctaa

SEQ ID NO: 150 - DNA, 1608 bp, Artificial sequence
  Gene sequence for Candida rugosa Lip1, codon-optimized for expression in Saccharomyces cerevisiae
atggccccaaccgccactttagctaatggtgacacaataaccggtttgaacgcaattataaacgaagcctttttaggtatccctttcgcagaaccacctgttggtaacttgagattcaaagatccagttccttattcaggttccttagacggtcaaaagttcacttcatacggtccatcctgtatgcaacaaaatcctgaaggtacatatgaagaaaacttgccaaaagctgcattggatttggttatgcaatcaaaggtctttgaagctgtatccccttcttcagaagattgcttgactattaatgttgtcagaccacctggtaccaaagctggtgcaaacttaccagttatgttgtggatctttggtggtggtttcgaagtcggtggtacttcaacatttccacctgctcaaatgattacaaaatccatagcaatgggtaaacctatcatacatgtatctgttaactacagagtttccagttggggtttcttggccggtgacgaaattaaagctgaaggttctgccaatgctggtttaaaggatcaaagattgggtatgcaatgggtcgctgataacatcgccgcttttggtggtgacccaaccaaagtaactattttcggtgaatcagcaggtagtatgtctgttatgtgtcacatcttgtggaatgatggtgacaacacttacaagggtaaaccattgtttagagctggtattatgcaaagtggtgcaatggttccttctgatgccgtcgacggtatctacggtaacgaaatcttcgatttgttggcatctaacgccggttgtggttcagcttccgataagttggcatgcttaagaggtgtttcttcagataccttggaagacgcaacaaataacaccccaggtttcttggcctattccagtttgagattatcttacttaccaagacctgatggtgtcaacattactgatgacatgtatgccttagtaagagagggtaaatacgctaacatccctgttataatcggtgaccaaaacgacgaaggtacatttttcggtacctcttcattgaatgtcactacagatgcacaagccagagaatacttcaagcaatcattcgtacatgcttccgatgcagaaattgacactttaatgacagcttacccaggtgacattacccaaggttcaccttttgacactggtatattgaacgctttgacaccacaattcaaaagaatctctgcagttttgggtgacttgggttttacattggccagaagatatttcttgaaccattacaccggtggtactaagtactcatttttatccaagcaattgagtggtttaccagtcttgggtactttccactctaacgatatcgtattccaagactatttgttgggtagtggttctttgatatacaacaacgcttttatcgctttcgcaactgatttggacccaaatacagcaggtttgttagttaaatggcctgaatacacatccagttctcaatctggtaacaacttgatgatgatcaacgctttgggtttgtacaccggtaaagataacttcagaactgccggttacgacgctttattcagtaatccaccttctttctttgtttaa

SEQ ID NO: 151 - DNA, 975 bp, Artificial sequence
  Gene sequence for Moesziomyces antarcticus CALB lipase, codon-optimized for expression in Saccharomyces cerevisiae
atgacaccattggtaaaaagattaccatctggttcagatcctgctttttcacaaccaaagtccgttttggacgcaggtttaacttgccaaggtgcctcaccttcttcagtatccaagcctattttgttagttccaggtacaggtactacaggtcctcaatctttcgattcaaactggattccattgagtacccaattaggttatactccttgttggatatctccacctccattcatgttgaatgacacacaagttaacaccgaatatatggtcaacgcaatcactgccttatacgctggttcaggtaataacaaattgccagtcttaacatggtcccaaggtggtttggtagctcaatggggtttaacctttttcccatccatccgtagtaaggttgatagattgatggcatttgcccctgactacaagggtacagttttagccggtccattggatgctttagcagtttctgcaccttcagtctggcaacaaaccactggttctgccttgacaaccgctttaagaaatgcaggtggtttgacccaaatcgttccaactacaaacttatactcagctactgatgaaatagtccaacctcaagtatccaatagtccattggactccagttacttattcaatggtaaaaacgtacaagcccaagctgtttgtggtcctttgtttgttattgatcatgctggttccttaacaagtcaattctcttatgttgtcggtagaagtgcattgagatctaccactggtcaagcaagatctgccgattacggtataactgactgcaatcctttgccagctaacgatttgacaccagaacaaaaggttgccgctgcagccttgttagctccagctgcagccgctatagttgcaggtcctaaacaaaattgtgaacctgatttgatgccatatgccagacctttcgctgttggtaaaagaacatgctctggtatcgtcaccccataa

SEQ ID NO: 152 - protein, 1509 aa, Artificial sequence
  Gene sequence for Brassica napus DGAT, codon-optimized for expression in Saccharomyces cerevisiae
ATGGCAGTCTTGGATTCTGGTGGTGTTGCCGTCCCTACTGAAAATGGTGTTGCTGATTTGGACAGATTACATAGAAGAAAATCCAGAAGTGATTCTTCAAACGGTTTGTTACCTGACACATCTCCATCAGATGACGTTGGTGCTGCAGCCGCTGAAAGAGATAGAGTCGACTCTGCAGCCGAAGAAGAAGCACAAGGTACCGCCAATTTGGCTGGTGGTGACGCTGAAACTAGAGAATCTGCAGGTGGTGACGTTAGATTCACTTATAGACCATCTGTCCCTGCTCATAGAAGAACCAGAGAATCACCATTATCCAGTGATGCCATATTCAAACAATCTCACGCTGGTTTGTTTAACTTATGTGTTGTCGTATTGGTAGCAGTTAATTCAAGATTGATCATCGAAAACTTAATGAAGTACGGTTGGTTGATCAGAACTGATTTCTGGTTCTCTTCAACATCATTGAGAGACTGGCCTTTATTCATGTGTTGCTTGTCCTTAAGTGTTTTCCCATTGGCTGCTTTTACTGTTGAAAAGATGGTCTTGCAAAGATTCATTTCTGAACCTGTCGCTATCATCTTGCATGTAATCATCACTTTGACAGAAGTTTTGTACCCAGTCTACGTAACATTGAGATGTGATTCTGCCTTCTTGTCAGGTGTTACCTTGATGTTGTTGACTTGCATAGTATGGTTGAAGTTAGTTTCTTATGCTCATACATCATACGACATAAGAACCTTGGCAAATTCCGCCGATAAAGTAGACCCTGAAATCAGTTATCACGTTTCCTTGAAGAGTTTAGCATACTTTATGGTTGCCCCAACCTTATGTTATCAACCATCCTACCCTAGAAGTCCATGCATTAGAAAAGGTTGGGTCGCTAGACAATTTGCAAAGTTGGTAATATTCACAGGTTTGATGGGTTTTATTATCGAACAATACATCAACCCTATCGTTAGAAACTCCAAACATCCATTGAAGGGTGACTTGTTATACGCTATCGAAAGAGTCTTGAAGTTGTCAGTACCAAATTTGTACGTTTGGTTGTGTATGTTCTACTGCTTTTTCCACTTGTGGTTGAACATCTTGGCTGAATTGTTGTGTTTCGGTGACAGAGAATTCTACAAGGACTGGTGGAATGCAAAGTCTGTTGGTGACTACTGGAGAATGTGGAACATGCCTGTTCATAAGTGGATGGTTAGACACGTCTACTTCCCATGTTTGAGAATCAAAATCCCTAAGGTTCCAGCCATCATTATAGCTTTCTTGGTATCAGCAGTTTTCCATGAATTGTGTATAGCCGTTCCTTGCAGATTGTTTAATTTGTGGGCTTTTATGGGTATCATGTTCCAAGTCCCATTGGTATTCATTACTAATTTCTTGCAAGAAAGATTCGGTTCCATGGTTGGTAACATGATTTTCTGGTTCAGTTTCTGTATCTTCGGTCAACCAATGTGCGTTTTGTTGTACTACCACGATTTGATGAACAGAAAAGGTTCTATGTCATAA

SEQ ID NO: 153 - DNA, 1533 bp, Artificial sequence
  Gene sequence for Brassica napus DGAT, codon-optimized for expression in Saccharomyces cerevisiae
atggccgtcttggattctggtggtgttgctgtccctactgaaaatggtgttgcagatttggacagattacatagaagaaaatccagaagtgactcttcaaacggtttaatttctgatacatctccatcagatgacgttggtgctgcagccgctgaagatgctagagacagagttgattcagccgtcgaagaagaagctcaaggtactgctaatttggcaggtggtgacactgaaacaagagaatccggtggtagaggtggtggtggtaacggtgacgttagattcacttatagaccatctgttcctgcacatagaagaaccagagaatcaccattatccagtgatgctattttcaaacaatctcacgcaggtttgtttaatttgtgtgttgtcgtattggtagctgttaattcaagattgatcatcgaaaacttaatgaagtacggttggttgataagaaccgacttttggttctcttcaacttctttgagagattggcctttattcatgtgttgcttgtccttaagtatcttcccattggcagcctttacagtagaaaagatggttttgcaaagattcatttctgaacctgttgctatcattttgcatgtcataatcaccttgactgaagttttatatccagtctacgtaaccttaagatgtgactctgcattcttgtcaggtgttacattaatgttgttaacctgcattgtctggttgaagttagtatcttacgctcatacttcatacgatatcagaacattggccaattccgctgacaaagtcgatcctgaaatcagttatcacgtatccttgaagagtttagcatactttatggttgccccaaccttatgttatcaaccatcctaccctagaagtccatgcattagaaaaggttgggttgcaagacaatttgccaagttggtcatattcactggtttgatgggttttattatcgaacaatacatcaaccctatcgttagaaactccaaacatccattgaagggtgacttgttgtacgcaatcgaaagagttttgaagttgagtgtccctaatttgtacgtatggttgtgtatgttctactgctttttccacttgtggttgaacatcttggcagaattgttgtgtttcggtgacagagaattctacaaggattggtggaatgccaagtcagttggtgactactggagaatgtggaacatgcctgttcataagtggatggttagacacgtctacttcccatgtttgagaatcaaaatccctaaggttccagctatcattatagcattcttggtatctgccgttttccatgaattgtgtatagctgttccttgcagattgtttaatttgtgggcttttatgggtatcatgttccaagtcccattggtattcattacaaatttcttgcaagaaagattcggttccatggttggtaacatgattttctggttcagtttctgtatcttcggtcaaccaatgtgcgttttgttgtactaccacgatttgatgaacagaaagggttctatgtcataa

SEQ ID NO: 154 - DNA, 1515 bp, Artificial sequence
  Gene sequence for Brassica napus DGAT, codon-optimized for expression in Saccharomyces cerevisiae
atggaaactttggattctggtggtgttaccatgcctactgaaaatggtggtgctgatttggacacattaagacatagaaaacctagatcagattcttcaaacggtttgttaccagactctgtaacagtttcagatgcagacgtcagagatagagtagactctgccgttgaagatacccagggtaaagccaatttggctggtgaaaacgaaattagagaatctggtggtggtggtggtgaagctggtggtaatgtcgatgttagatatacttacagaccatccgtccctgcacatagaagagtaagagaaagtccattatccagtgacgctattttcaaacaatctcacgcaggtttgtttaacttatgtgttgtcgtattggttgctgtcaattcaagattgatcatcgaaaacttaatgaagtatggttggttaataagaaccgatttttggttctcttcaacttccttgagagactggcctttgtttatgtgttgcttgtctttgtcaatattcccattggctgcattcactgtcgaaaagttggtattgcaaaagtgtatatcagaacctgttgtcatattcttacatgttatcataactatgacagaagtcttgtatccagtatacgttacattaagatgtgattccgcatttttgagtggtgttacattgatgttgttgacctgcatagtatggttgaaattagtttcctatgcacacactaactacgatatcagaacattggcaaattccagtgacaaagccaaccctgaagttagttattacgtctccttgaagagtttagcctatttcatgttggctccaacattatgttatcaaccatcttaccctagatcaccatgcattagaaaaggttgggttgcaagacaatttgccaagttgataatcttcaccggttttatgggtttcattatcgaacaatacatcaaccctatcgttagaaactccaaacatccattaaagggtgacttgttgtacggtatagaaagagtcttgaagttgagtgtaccaaatttgtacgtttggttgtgtatgttctactgctttttccacttgtggttgaacatattggccgaattgttgtgtttcggtgacagagaattctacaaggactggtggaatgcaaagtcagttggtgactactggagaatgtggaacatgcctgttcataaatggatggtcagacacgtatacttcccatgtttgagaagaaacatccctaaggttccagctatcattttggcattcttagtttctgccgtctttcatgaattgtgtattgctgttccttgcagattgtttaaattgtgggctttcttaggtatcatgttccaagtaccattggttttcatcaccaactacttacaagaaagattcggttctatggttggtaacatgatcttttggttcactttctgtatcttcggtcaaccaatgtgcgttttgttgtactaccacgatttgatgaacagaaagggtaaaatgtcttaa

SEQ ID NO: 155 - DNA, 1557 bp, Artificial sequence
  Gene sequence for Tropaeolum majus DGAT, codon-optimized for expression in Saccharomyces cerevisiae
atggcagttgccgaatcttcacaaaatactacaaccatgtctggtcatggtgactcagacttgaataacttcagaagaagaaaaccatccagttctgttattgaaccttcatccagtggttttacttctacaaatggtgttccagctaccggtcatgtcgcagaaaacagagatcaagacagagtcggtgctatggaaaatgcaactggttctgtaaatttgattggtaacggtggtggtgttgttattggtaacgaagaaaagcaagtcggtgaaaccgatataagattcacttatagaccatctttccctgctcatagaagagttagagaatcacctttgtcttcagacgcaattttcaaacaatctcacgccggtttgtttaatttgtgtatcgtagttttgattgcagttaattcaagattgataatcgaaaacttaatgaagtacggttggttgattgatacaggtttttggttctccagtagatccttgggtgactggagtatttttatgtgttgcttgaccttaccaatattccctttggctgcttttattgtcgaaaagttggtacaaagaaaccatatctctgaattggtagctgttttgttacacgtcattgtatcaactgccgctgttttgtacccagttatagtcatcttgacatgtgattccgtctacatgagtggtgtcgtattgatgttattcggttgcatcatgtggttgaagttagtttcttacgcacatacatcttcagatatcagaaccttggccaaatccggttacaagggtgacgctcacccaaacagtacaatagtatcttgttcatacgatgtttctttgaagtcattagcctactttatggttgctcctactttatgttatcaaccatcataccctagatccagttgcattagaaaaggttgggttgtcagacaatttgttaagttgatcgtcttcattggtttgatgggttttatcatcgaacaatacatcaacccaatcgttagaaactctaaacatcctttgaagggtgactttttgtacgcaattgaaagagtcttgaaattatccgtaccaaacttgtacgtttggttgtgtatgttctactctttctttcacttgtggttgaacatattggccgaattgttgagattcggtgacagagaattctacaaggactggtggaacgccaagacagttgctgaatactggaaaatgtggaatatgcctgtccatagatggatggttagacacttgtacttcccatgcttgagaaacggtatacctaaggaaggtgcaataatcattgccttcttggtttcaggtgcttttcatgaattatgtatcgcagtaccatgccacgttttcaaattgtgggcttttattggtatcatgttccaagtacctttggttttgatcactaactatttgcaagaaaagttttccaacagtatggttggtaacatgattttctggttcattttctgtatcttgggtcaaccaatgtgcgttttgttgtactaccatgatttgattaatttgaaagaaaagtaa

SEQ ID NO: 156 - DNA, 1377 bp, Artificial sequence
  Gene sequence for Acinetobacter calcoaceticus wax-ester synthase/DGAT, codon-optimized for expression in Saccharomyces cerevisiae
atgagaccattgcatcctatcgatttcatcttcttgtctttggaaaagagacaacaaccaatgcacgttggtggtttgtttttattccaaataccagataatgcacctgacacctttatacaagatttggtaaacgacatcagaatctcaaagtccataccagttccacctttcaataacaagttgaacggtttattttgggatgaagacgaagaattcgatttggaccatcactttagacatatcgctttaccacaccctggtagaattagagaattgttgatctatatctcccaagaacatagtactttgttggatagagctaagccattgtggacatgtaacatcatcgaaggtatcgagggtaacagatttgcaatgtacttcaagatccatcacgcaatggtcgatggtgtagccggtatgagattgatcgaaaaatctttgtctcacgacgttacagaaaagtctattgtaccaccttggtgcgttgaaggtaaaagagccaagagattgagagaaccaaagaccggtaaaattaagaaaattatgtctggtattaaatcacaattgcaagctactcctacagtcatacaagaattgtcacaaactgtattcaaggatatcggtagaaatccagaccatgtttcttcatttcaagctccttgttctattttgaaccaaagagtctccagttctagaagatttgctgcacaatccttcgatttggacagattcagaaacatcgcaaagagtttgaacgttacaatcaacgatgttgtcttagccgtctgctctggtgccttgagagcttatttgatgtcacataattccttgcctagtaagcctttaattgctatggtcccagcatcaatcagaaacgatgactctgatgtatcaaacagaatcacaatgatcttggcaaatttggccacccacaaagatgaccctttgcaaagattagaaatcatcagaagatccgttcaaaacagtaagcaaagattcaagagaatgacatctgatcaaatcttgaactactcagctgtagtttacggtccagcaggtttaaacataatctctggtatgatgcctaagagacaagcttttaatttggttatttcaaacgtcccaggtcctagagaaccattatattggaatggtgccaagttggatgctttataccctgcatccatcgttttggacggtcaagctttaaacataaccatgacttcttacttggataagttagaagttggtttgattgcctgtagaaatgctttaccaagaatgcaaaacttgttgacccatttggaagaagaaatccaattgttcgaaggtgttatagccaaacaagaagatatcaagactgctaattaa

SEQ ID NO: 157 - DNA, 1398 bp, Artificial sequence
  Gene sequence for Mycobacterium rhodesiae DGAT, codon-optimized for expression in Saccharomyces cerevisiae
atggaacatttgactacattagatgcttcatttttgcaagcagaagattctgattcacatgtttctttagctgttggtggtgtttcaattgttgaaggtccaccaccagattatggtgacttggtttctgcttttgcagaaagagcacaagcaattccaagatgtactcaagttttgagaacacatccatttgatttgggtgctccagaatgggttgatgatccaaattttgatgttgctcatcatttgcatagaattgcattaccacatccaggtgacgatgctgcattgtttgctatgattgcaggtattatggaacaaagattggatagagatagaccattatgggaatgttggattattgaaggtttaactgatgatagatgggctttgttgatgaagatccatcattgtatcgctgatggtatcgcaactacacaaatgttggcaaaattgtctgatggtggtgctggtgaatcttttgcatcaaatattagagctgcaagagaagctgatggttcaattttggaattgttaagaccaagattgaacccattgaattggatgggtggtatttggagagctactttagctgcaacatctgctgctgaacatgcagttgttggtgctgctgaattgactgctagagttttaacagcaggtcaagaatcttcattgaatggtccagttacaaaaatgagaagatattctgctgctagagctgatttggcagttatgaagcaagtttcaagagatttcgatgttactttgaacgatgttgctttagctgcaattacatctggttacagagctattttgttagcaagaggtgaaactccaggtccacatgctttgagaacattagttccagtttctatgagatcagttgaagatttcgatttgactgataacagagtttcagctatgttaccattgttaccagttgatgaaccagatccagttaagcaattggaaatcgttcatcaaagattgacagaagctaaggaatctggtcaaagagaaggtggttcagcagtttttgctgcatctggttcattgccatttgttttctctgcttgggcaatcagattgttgactagattgccacaaaaatctgtttcagctttagcaactaatgttccaggtccaagaacaagacaaagattgatgggtagagatgttttggaaattttaccagttccaccaattgctttgcatttgagaactggtattgctatgttgtcttacgcagatagatttttctttggtatcacagctgatttcgattcagcaccagatgttgatgctttagcaagaggtattgaagatggtattagacatttggctacattgggtggttcaagagttcaaccaagagctgctggtgaacatagataa

SEQ ID NO: 158 - DNA, 1419 bp, Artificial sequence
  Gene sequence for Mycobacterium aurum DGAT, codon-optimized for expression in Saccharomyces cerevisiae
atggaaagattgtcagcattagatgctggtttcttgcaagcagaagatgctgatagacatatttcattagttgttggtgctgtttctgttttggatggtccagttccagatcaagatgaaatcgttgcttctatcggtgaaagaatcatgggtattccaagattgagacaagttgttagaagacaaccatttgatttggctgcaccagtttgggaagatgatgctgatattgatttggcacatcatattcatagagctgcattgccagctccaggtgacgatgaagcattgtttagattcactgctgaagctatggaaacaagattagatagagaaagaccattgtggcaatgttggattgttgaaggtttggctgattcaagatgggcaattgttatgaaagttcatcattgtgttgctgatggtattgcaacaatgcacatgttggttggtttatctgatggtgaccaagatgatacttatgttgatgcaattagagctggtcatgcatcttcaggtccagttccatcttcaccagcaccaacattgaatccattaagatggttgaaatcagcttggggtactgctgcaacagttgcttcttcatctgttgttgttgcagaaggtttcgttgaaatcgttgattctttagttagatcaggtccatctccattgaatggtccagttactacaatgagaagatactcagctgttcaagttccattagctactgttacagcagtttctcaaggtttcggtgttacattgaacgatgttgctttgtcagcaattactgattcttttagagctgcattgttaagaagaggtgaaactccaagacatgattcattaagaacattggttccagtttcagttagaacttctgatgctatggatcatgttgataacagagtttctgttatgttgccatatttgccagttgatgaaccagatagagttaagcaattgagagctgttcatgaaagattgaacagagcaaaaggttctggtcaaagacaagctggtactgctgctgttacagttgttgatttggttccatttgcattggcttcaagagctattagagcattaacttctttgccacaaagaggtattgttactttggctacaaatgttccaggtccaagaagacatttgcatgttatgggtagaaatgttgttagaatgttgccagttccaccagttgctttgagattaagagctggtgttgcaatcttgtcttatggtgacgatttggttttcggtatcacagcagatttcgattctttcccagatgttgatgaattagctggtggtattcaagaagcaatggcttgtttgtacgctgctgctagaagaccaaaatctgctagaaaaactccattggcattagttagaccagttgaagatgctcaataa

SEQ ID NO: 159 - DNA, 1431 bp, Artificial sequence
  Gene sequence for Mycobacterium diernhoferi  DGAT, codon-optimized for expression in Saccharomyces cerevisiae
atggatagattgaatacatttgatgctggtttcttggatgctgaagatgcagatccacatgtttctttagctgttggtgcagtttcaattttggatggtccattaccagatagagatgctttggcaactttaattggtgacagaattgctgctgttccaagattgagacaagttgttagaagacaaccatttgatttgtctgctccagaatgggttgaagatccagctttggatatggcacatcatattagaagagctgcattgccacatccaggtgacgatgctgcattgtttagattcactgctgaagcaatggaatcaagattggatagagaaagaccattatggcaatgttggattattgaaggtttagctgctgatagatgggctttgttgatgaaggttcatcattgtatcgcagatggtattgctgcaatgcatttgttagctggtttgggtgacggtggtgaaggtcaaacttatgttggtgctattagagctgcacatgcaccaccacatagaccaagaacattgccaactttaacagctgatccaagaactttagttagaggtgttgttaattctgtttcagctttgacttactctacagcagttactgttggtggtacagttcaaattttagattctttgttgagaccaggtccaaaatcagcttttaatggtccagtttctactatgagaagatactcagctgcacaagttccattggctgatgttgcatcagtttgtcaagcatttgatgttacattgaacgatgttgctttgtctgcaatcactgattcttttagagctgcattacaaagaagaggtgaagttccaagaagaacatctttgagaactttagttccagtttcagttagaccaggtgctgcaatgggtgaattggataacagaatctctgttatgttgccacatttgccagttgatgaatcagatccattggaacaattaagaacagttcatagaagaatggctagagttaaatctggtggtcaaagacaagctggtggtatggcagttgctgcattgaaattagttccattcgcattgacttcaagagttgttagattgttgacttcattgccacaaagaggtgttgttacattagctactaatgttccaggtccaagacatcatttgcaagttatgggtagagaagttgttagaatgttgccaattccaccagttgctttaagaatgagagctgctgttgcaattttgtcttatggtgacgatttggtttttggtgttactgctgattttgatgcatttccagatgttgatgatttggctgatggtattgctggtgcaattacaagattggctactgttgcaagacatccagaaccaagaaaagaacatcatgatccatcaccaggtgctcaagaaaattcttgtagatcaggttaa

SEQ ID NO: 160 - DNA, 1410 bp, Artificial sequence
  Gene sequence for Mycobacterium vaccae DGAT, codon-optimized for expression in Saccharomyces cerevisiae
atggttacaagattgtctgctgctgatgcttcattttacagattagaaaattcttcaacaccaatgtacgttggtactttgcaaattttaagaaagccaagaaacggtttgtcttatgaaacattgttagaaactgttgaacaaagattaccacaaattccaagatacagacaaaaagttagagaagttgcttttaatttggctagaccagtttggattgatgatagagatttcgatatcacttaccatatcagaagatcagctttaccatctccaggttcagatgcacaattgcatgaattagttgctagattgggttcaagaccattggataaatcaagaccattgtgggaaatgtatttggttgaaggtttggctaaaaatagaatcgctatctatacaaagtctcatcaagcattggttaacggtatggctgcattagaaattggtcatgttattgcagatagaactcaaaaagctccagaatttggtgaagatatttggattccaggtagagaaccatcagatagacaattgatgttaggtgcattgggtgaatggattatgagaccaacagctcaagctgctgctgttagatcaactgttgttgaagcagttactaatgcttcaagaatggttgaattaggtagaagaggtgcagaaattgctagaactgttgcaagaggtgcagctccatcttcaccattgaacactactgtttcaagaaacagaagattttcagttgcttctggttcattagatgagtttagagcagttagagctagatacgaatgtgatgttaacgatgttgttttggcaatgattgcaggtgctttaagaaattggttgttgtcaagaggtgaaccagttagagctactacaactgttagagcaatggctccaatgccagtttacccagatggtgacattgattcaaatggtccaggtcaagcaattggtgaagttgctccatttttggttgatttgccagttggtgaagctaatccagttgttagattgacacaaattgcacatgctacagaaactcatccaactgcaccatctttagttgatgctagaacaatcatcactttgtcaggttttgcaccaccaacattacatgctatgggtattagagttgcaacttctttttcagctagattgtttaatttgttgatcacaaacgcaccaggtgctcaaaagcaaatgtacgttgcaggtacaaaattgttagaaacttacgctgttccaccattgttacataatcaaacattggctatcggtgttacttcttacaacggcatgttgtacttcggtattaatgcagatagagatgctatgtcagatgttgatatgttgccatctttgttgagagaatcattggatgaattagttgaagcagctagataa

SEQ ID NO: 161 - DNA, 1518 bp, Artificial sequence
  Gene sequence for Arabidopsis thaliana GPAT, codon-optimized for expression in Saccharomyces cerevisiae
atgtctccagctaagaaatctagatcatttccaccaatctctgagtgtaagtcaagagaatacgattctattgctgcagatttggatggtactttgttgttgtcaagatcttcattcccatacttcatgttggttgctattgaagcaggttctttgtttagaggtttgatcttgttgttgtcattgccaatcgttatcattgcttatttgtttgtttctgaatcattaggtattcaaattttgattttcatttcttttgctggtattaaaattaaaaatatcgaattagtttcaagagcagttttgacaagattttacgctgcagatgttagaaaggattctttcgaagttttcgataagtgtaagaaaagaaaggttgttgttactgcaaatccaattgttatggttgaaccattcgttaaggattatttgggtggtgacaaggttttgggtacagaaatcgaagttaacccaaagactatgaaggctacaggtttcgttaagaaaccaggtgttttagttggtgacttgaagagattggcaatcttgaaggaattcggtgacgattcaccagatttgggtttgggtgacagaacttctgatcatgatttcatgtcaatctgtaaagaaggttacatggttcatgaaacaaaatctgctactacagttccaatcgaatcattgaaaaatagaatcatcttccatgatggtagattggttcaaagaccaactccattaaacgcattgatcatatatttgtggttgccattcggttttatgttgtctgtttttagagtttacttcaatttgccattgccagaaagattcgttagatacacttacgaaatcttaggtattcatttgacaattagaggtcatagaccaccaccaccatcaccaggtaaacctggtaatttgtacgttttgaaccatagaactgctttagatccaatcatcatcgctatcgcattgggtagaaagatcacttgtgttacatactctgtttcaagattgtctttgatgttgtcaccaattccagctgttgcattaacaagagatagagttgcagatgctgcaagaatgagacaattgttagaaaagggtgacttggttatttgtccagaaggtactacatgtagagaaccatatttgttgagattttctgctttgttcgcagaattgtcagatagaatcgttccagttgctatgaactgtaagcaaggcatgttcaacggtactacagttagaggtgttaagttctgggacccatactttttctttatgaatccaagaccatcttacgaagctacatttttggatagattgccagaagaaatgactgttaatggtggtggtaaaacaccattcgaagttgcaaactacgttcaaaaagttattggtggtgttttgggtttcgaatgtactgaattgacaagaaaggataagtacttgttgttgggtggtaatgatggtaaagttgaatctattaataagacaaaatcaatggaagtcatgtaa

SEQ ID NO: 162 - DNA, 1137 bp, Artificial sequence
  Gene sequence for Brassica napus GPAT, codon-optimized for expression in Saccharomyces cerevisiae
atgtcttcaactgctggtagattggttacatctaagtcagaattggatttggatcatccaaacatcgaagattatttgccatctggttcttcaattaatgaaccaagaggtaaattgtctttgagagatttgttggatatctcaccaactttgacagaagctgcaggtgcaattgttgatgattcttttactagatgtttcaagtcaaatccaccagaaccatggaactggaacatatatttgttcccattgtactgtttcggtgttgttgttagatactgtatcttgttcccattgagatgtttcacattggctttcggttggattattttcttgtctttgtttattccagttaacgcattgttgaagggtcaagatagattgagaaagaaaattgaaagagttttggttgaaatgatctgttctttctttgttgcttcatggactggtgttgttaaatatcatggtccaagaccatctattagaccaaaacaagtttacgttgcaaaccatacttcaatgatcgatttcatcgttttggaacaaatgacagcttttgcagttattatgcaaaaacatccaggttgggttggtttgttgcaatctacaatcttggaatcagttggttgtatctggttcaacagatctgaagctaaggatagagaaatcgttgctaagaaattgagagatcatgttcaaggtgctgattcaaacccattgttgatcttcccagaaggtacttgtgttaacaacaactacacagttatgttcaagaaaggtgcattcgaattggattgtactgtttgtccaatcgctattaaatacaataagatcttcgttgatgcattctggaattctagaaagcaatcttttactatgcatttgttacaattgatgacatcttgggctgttgtttgtgaagtttggtatttggaaccacaaactattagaccaggtgaaacaggtatcgaattcgctgaaagagttagagatatgatctctttgagagcaggtttgaagaaagttccatgggatggttatttgaaatactctagaccatcaccaaagcattcagaaagaaagcaacaatctttcgctgaatcaatcttggcaagattagaagaaaaagtcatgtaa

SEQ ID NO: 163 - DNA, 1374 bp, Artificial sequence
  Gene sequence for Brassica napus GPAT, codon-optimized for expression in Saccharomyces cerevisiae
atgttagttgctttcgaaacaggtggtatcatcagatcatttttgttgtttattttgtacccttttatttctttgatgtcatacgaattgggtatgaagacaatggttatggtttctttctttggtattaagaaagaaaagttcttgttaggtacttctgttttgccaaaatactttttggaagatgttggtttggaaatgttcgaagttttgaagagaggtggtaaaagagttggtgtttctgatttgccacaagttatgatcgatggtttcttggaagattatttgggtattgaagttgttgttggtagagaaatgaagatgatcggtggttactactcaggtattttagaagataaaaagaaacatgaattctacttgggtgaattggttcaagaagaaaagttgtcttcaggtcatgttatcggtatcacatcttacaatttgccatctcatagatcattgttttctcaattctgtcaagaaatctatttcgttagaaactcagataagaaatcttggcaaactttgccaagaaaccaatacccaagaccattgatcttccatgatggtagattggcaattaaaccaactccaacaaatactttggctttgtttatgtgggcaccatttgctgcagttttagctacagcaagaactgttgctggtttgaatttgccatactcattagctattccatttttggcattttctggttttagattgacattgactgttaacaacgatttgatctctccagatcaaaaggaaggttgtttgttcgtttgtaaccatagaactttgttagatccattgtacatctcatacgcattgagaaagacaaacatcaaggctgttacttactctttgtcaagattgtctgaattgttggcaccaattaaaacagttagattgactagagatagagttcaagatggtcaagctatgaaaagattgttaagacagggtgacttggttgtttgtccagaaggtactacatgtagagaaccatacttgttgagattttcaccattattcgctgaagtttctgatgcaattgttccagttgctattgattcacatgttactttctttcatggtactacagcatctggtttgaaggctttcgatccaattttctttttgttgaacccatacccaacatacactgttagattgttagatccagtttttggtggtggttcttctacttgtagagatccagatgatggtaaatctaagttcgaagttgcaaaccatgttcaacatgaaatcggtaaagctttgggtttcgaatgtacaaatttgactagacgtgataagtatttgattttagctggtaataatggtgttgttgataagaaagtcatgtaa

SEQ ID NO: 164 - DNA, 1101 bp, Artificial sequence
  Gene sequence for Brassica napus GPAT, codon-optimized for expression in Saccharomyces cerevisiae
atgttcaaggttttgagaaaaggtggtaaaagaatcgttgtttcatacgatttgccacaagttatgattgaaggtttcttgagagattacttggaagttgaagttgttgttggtagagaaatgaaagttgttggtggttattacttaggtatcatggaagataagactaagcatgatttggtttttgatgaattagttagaaaagaaagattgaacacaggtagagttattggtattacttcttataatacatcattacatagatacttgttttctcaattctgtcaagaaatctatttcgttaagagatctgataagagaacttggcaaacattgccaaagtcacaatacccaaagccattgatcttccatgatggtagattggctattagaccaactttgatgaacacattggctttgtttatgtggggtccatttgcagttttagctgcagctgcaagattgttcgtttcattgtgtatcccatacactttgtctatcccaatcttgtctttctttggttgcagattgacagttaagatcgatgatgtttcttcacaaaagttgaattcttcagaaagaaagggttgtttgttcgcttgtaaccatagaactttgttagatccattgtatgttggtttcgcattgaaaaagaaaaatatcaagactgttacatactctttgtcaagagtttctgaaatcttggctccaattaaaactgttagattgacaagagatagagtttcagatggtcaagctatgaagaaattgttagcagagggtgacttggttgtttgtccagaaggtactacatgtagagaaccatatttgttgagattttctccattgttcgctgaaatctcagatgttatcgttccagttgctgttacttctccagcaactttcttttatggtactacagcttcaggtttgaaggcattcgatccattgtttttcttgatggacccatacccaacttacacagttcaattcttagatccagttccaggtgttacatgtcaagatccagagggtaaattgaagttcgaagttgctaaccatgttcaatctgctattggtaaagcattggatttcgaatgt

SEQ ID NO: 165 - DNA, 1512 bp, Artificial sequence
  Gene sequence for Brassica napus GPAT, codon-optimized for expression in Saccharomyces cerevisiae
atgggttctcaagaaaagagaagaagattccaaccaatcacatcttacgaaattaaagatagatcaaatcaaacagttactgctgatttggatggtactttgttgatttctagatcagcattcccatactactttttggttgctttagaagcaggttctttgttaagagctttgatcttgttggcatcagttccattcgtttatttgacatacttatctgtttcagaaactttggctattaatatttttattttcattacattcgcaggtttgaagatcagagatgttgaattggttgttagatctgttttaccaagattttacgctgaagatgttagaccagatgcatggtctattttcaatacattcggtaaaagatacattgttactgcttcaccaagagttatggttgaaccattcgttaagacatacttaggtgttaataaggttttgggtactgaattagaagtttctaagtcaggtagagctactggttttgttagaagaccaggtgttttggttggtcaacataagtgtgatgctatcttgagagaatttggtggtgttgcatcaggtttgccagatttgggtttgggtgactctaaaacagatcatgatttcatgtcaatctgtaaggaaggttacatggttccaagaactaaatgtgaaccattgccaagaaataagttgttgaacccaatcatcttccatgaaggtagattggttcaaagaccaacaccattagttgctttgttgactttgttgtggttaccagttggtttcttggtttctttgatcagagtttacacaaacatcccattgccagaaagaatcgcaagatacaactacaagttgactggtattaaattaattgttaatggtaatccaccaccaccaccaaaaccaggtcaaccaggtcatttgttggtttgtaaccatagaacagttttagatccagttgttactgctgttgcattgggtagaaagatctcatgtgttacatactctatctcaaaattttctgaattgatttcaccaattaaagctgttgcattaactagacaaagagaaaaggatgctgcaaacatcaagagattgttagaagagggtgacttggttatttgtccagaaggtactacatgtagagaaccatttttgttgagattttctgctttgttcgcagaattgacagatagaatcgttccagttgctattaatactaagcaatcagtttttaatggtactacaactagaggttacaagttcttagatccatacttcgcttttatgaacccagttccaacattcgaaatcacatttttgaagcaattaccagcagaattgacttgtaaaggtggtaaatctccaatcgaagttgctaactacattcaaagagttttggcaggtacattaggttttgaatgtacaaacttcactagaaaggataagtacgctatgttggcaggtactgatggtagagttccagttaagaaagaaaagattgtcatgtaa

SEQ ID NO: 166 - DNA, 1707 bp, Artificial sequence
  Gene sequence for Brassica napus GPAT, codon-optimized for expression in Saccharomyces cerevisiae
atggaatcttcaactacaacttcttactcagttgtttctgaattagaaggtacattgttgaagactccaaagccattcgcatacttcatgttgatggcattcgaagcttcaggtttgatcagatacactttgttgttgtttttatggccaatcatcgctttgttggatgtcttgggttacagaaacggttctttgaagttgatgatttttgttgctactgcaggtttaagagaatctgaaattgaatcagttgctagagcagttttgccaaagttctacatggatgatatctctatggatgcttggagagtttttggttcatgtgaaaagagagttgttgttacaagaatgccaagagttatggttgaaagattcgcaaaggatcatttgagagctgatgaagttattggtacagaaatcattattaacagatttggttatgcaactggttttattcaagaatctgatgttgatagatctattttcaattcagttgctaatttgttcgaagatagaagaccacaattaggtttgggtagaccaatcatctctggttcacaaacatttttgtctttgtgtgaagaacaagttcatgctccagttccatcaaactacaacgttcaaagattgcatgttcaattgttgccagttattttccatgatggtagattggttaagttgccaacaccagctactgcattgttgatcttgttgtggattccattcggtatcgttttggcagttgttagattgtttattggttctatgttgccattgtgggctattccatacgtttcaagaattttcaatatcagattcattgttaaaggtaaaccaccagctccagcatctgctggtaaccaaggtgttttgttcgtttgtacacatagaactgttatggacccagttattttgtcttacgttttgggtagatcaattccagctgttacatactctgtttcaagattgtctgaaatcttgtcaccaatcccaacttttagattgactagagttagagatgttgatgctgaaattattaagaaagaattgtctaatggtgacttggttgtttacccagaaggtacaacttgtagagaaccatttttattgagattttcagcattgttcgctgaattgactgataagatcgttccagttgcaatgaactacagagttggtttctttcatgcaacaactgctagaggttggaaggctttcgatccaattttctttttcatgaatccaagaccagtttacgaagttacatttttaaaccaattggaagttgaagcaacttgttcttcaggtaaatctccatacgatgttgctaactacgttcaaagaattttagctgcaacattgggttttgaatgtacaaacttcactagaaaggataagtatagagttttagctggtaatgatggtactgtttcatactcttcatttttggatcaattcaagaaaactgctagattgtttttcgttttggcagttactgatgatgcttctttgatcgaagttccagttagaagaaagaatttgccaattaatgttatcggtgttgcaacatcttcaatttcaggtgaagctaactgttctttccattcatacgtttggcaaattaatccaggtacagaagttgaattaggtgacactcaattgcaatacttctctttccatcatccagaattgggtactgtcatgtaa

SEQ ID NO: 167 - DNA, 1122 bp, Artificial sequence
  Artificial sequence
atgtcttcaggtgctggtaaattggttacttctagatcagaattgaacatcgaagattatttgccatctggttcttcaatcgaagaaccaagaggtaaattgagattgttggatttgatcgatatctcaccaactttgacagaagctgcaggtgcaatcatcgatgattcttttacaagatgttttaaatcaaatccaccagaaccatggaactggaacatatatttgttcccattgtggtgtttcggtgttgttgttagatactgtatcttgttcccattgagatgtttgactttggctttcggttggttcattttcttgtctacttttattccagttcattcattgttgaaaggtcaggataagttgagaaagaatatcgaaagagttttagttgaaatgatctgttctttctttgttggttcatggactggtgttgttaaatatcatggtccaagaccatctattagaccaaaacaagtttacgttgctaatcatacttcaatgatcgatttcatcgttttagaacaaatgacagcttttgcagttattatgcaaaaacatccaggttgggttggtttgttgcaatctacaatcttggaatcagttggttgtatctggttcaacagatctgaagctaaggatagagaaatcgttgcaagaaagttgagagatcatgttcaaggtgctgataacaacccattgttgatcttcccagaaggtacttgtgttaacaacaactacacagttatgttcaagaaaggtgcattcgaattgggttgtactgtttgtccaatcgctattaaatacaataagatcttcgttgatgcattctggaattctagaaagcaatcttttactatgcatttgttacaattgatgacatcttgggctgttgtttgtgaagtttggtacttagaaccacaaactattagaccaggtgaaacagctatcgaattcgcagaaagagttagagatatgatctctttgagagcaggtttgaagaaagttccatgggatggttatttgaagtactctagaccatcttcaaagcattcagaaagaaagcaacaatctttcgctgaatcattgttagcaagattagaagaaaaagtcatgtaa

SEQ ID NO: 168 - DNA, 1308 bp, Artificial sequence
  Gene sequence for Chlamydomonas reinhardtii GPAT, codon-optimized for expression in Saccharomyces cerevisiae
atgactagacaaacatcttttcaaactccagcaggtggtccaggtgctttggaaagatgtggttcattacaaggttacggttctggtttgagatcattgaaaaataagactttttctagaggtgacttgtcaacatttggtgctgaacaagaattgcaacatgatggtacagctgcagcttctgatatgcaaagagaagttgaagatgcagttgtttctgctgaaagaggtgcaggtgctcattcaaatttgatgagagatatcttggatatttcttcaccattaaatgatgcagctgcagctttggttgatgattcatttttaagatgtttcaagactttgccagatgaaccatggaactggaacatatatttgtacccattgtgggctgttggtgttgttgttagaaattgtatcttgttcccattgagattgatcatcttgttgttgggtttcttggttttcgttgcaggttttgcagctgttggtgctgttgttaaaggtcatagaaaacaacaagctgaaagaagattggttcaattcttgtgtcaagttttcgttgtttcttggacaggtgttattagataccatggtccaagaccagttccagcaccaggtagagtttgggttgctaaccattcttcaatgatcgatttcgcagttttgggtgcttattctccatttgcagctattatgcaattacatccaggttgggttggcatgttgcaaagaagatacttatcagccttgggttgtttgtggttcaacagaactgaagcaaaggatagaacattggttgctagaagaatgagagaacatgttcatgatccaaactctactccattattgatcttcccagaaggtacatgtgttaacaacgaatacgttgttatgttcaagagaggtgcattcgatttggatgctactgtttgtccaatcgcaattaaatacaataagatcttcgttgatgctttctggaactcaaagagacaatctttttcagcacatttggttaagttgatgtgttcttgggctttggtttgtgatgtttggtttttggaaccacaatcaagaagaccagaagaaacagcacaacaatttgctgaaagagttcaaagaatgatcgcagataaggctagattgagagttgcaccatgggatggttatttgaagtactacaatttgggtgacaagcatccagatttgatcgaaaagcaaagaagagtttactctgatgctattaaagcatttgctgatccacaaccagcagctagaggtggtggttctaaaggtggtaaagtcatgtaa

SEQ ID NO: 169 - DNA, 1389 bp, Artificial sequence
  Gene sequence for Raphidocelis subcapitata GPAT, codon-optimized for expression in Saccharomyces cerevisiea
atgtctgttactgaagctgcaccaaatggtgttgcaagaactacatctgctcaattccattcatttttgccaggtttgactatgccagctggtcatgctgcagctgcagctgatgatttggcagaattaacagatagagaagttgaacaagcttatgttgcagctgaagaagaaagattgttaggtcattctcattcattgttgacagatatgttgtctatcgaaggtgttttggctgatgcagctgcagctgttgttgatgattcttttaataagtgtttcacttctacaccatcagatccatggaactggaatttgtatttgttcccaatgtggttgttgggtgttgtttttagatacgttatcttgttcccattgagattgttcggtttgatcgcttgtttcgcagctttctttttgatgtttttcccagttaaagcattgtggccaccaggtagaactaagttggctgttgaacaaagattgattagattcatgtgtggtggttttgttttatcttggacaggtgttattagatttcatggtccaagaccaattagaggtgcaggtagagtttgggttgctaaccatacttcaatgatcgattacatcattttgtcttcatactctgcatttgctgttattatgcaattacattcaggttgggttggtttcttgcaaactcaatgtttggattctttgggttgtttgtggttcaacagaacagaagttaaggatagacatttggttgctcaaagaatgagacaacatgttcatgcagatgctactccattgttgatcttcccagaaggtacatgtgttaacaacgaatactgtgttatgttcaagagaggtgcattcgaaatggatgctgttgttcatccaatcgcaattaaatacaataagatcttcgttgatgctttctggaattctagaagacaatcttttactcaacatttgttgaagttgatgacatcttgggcagttgttgctgatgtttactttttggaaccacaaagaagaagagaaggtgaaggtactgatggttttgcatcaagagttcaagaaatgatcgcaagaaaggctaatttgagagttgttccatgggatggttacttaaagtactacaatttgggtgaaaaacatccaggtttgattgaaaagagaagaagagtttacgctgatgttttgagaaagtacttgagaccatctgaagctggtggtggtgctggtgctggtggtgctagaccaggttctggtggtggtggtagagcagctggtgttggtagagttgaagaaggtgaagaagaaggtgaacagcagcaacaacaacaacaaagaccaaatggtgcagcttcaccagaaactaagaaagttaatgtcatgtaa

SEQ ID NO: 170 - DNA, 1287 bp, Artificial sequence
  Gene sequence for Micractinium conductrix GPAT, codon-optimized for expression in Saccharomyces cerevisiae
atgtctgcttcagttagatttcaagaaagacaagctgatggtaatggtgcattacaaagaactacatctggtttgggttatggtttgagatctttgaaaaataagactttttctagaggtgacttgactacatttgaagaattgcataaaggtccaaattcagctgaaatgcaaagagctattgatgaagcagttgttactgctgaaagagaagcatgtgctgcattaggtgctggtaacgttgttagagatgttttggatattgcatctccattgaatgatgctgcagctgcaattgttgatgattcatttttgagatgtttcaagtcatgtttggatgatccatggaattggaatgcttatttgtttccaatgtgggttttgggtgttgcagttagaaatttgttgttgttcccattgagattgattatgttgttgttgggtgctttgattttcattgctggttacgcattggttggtttggttttgaagggtcaaagattgaagagagcagaaagatggttggttcaattcttgtgtcaaatgttcgttgtttcttggacaggtgttattaaataccatggtccaagaccagttccacaagctggtagagtttgggttgcaaaccattcttcaatgatcgatttcgctgttttgggtgcatattcaccatttgctgcaattatgcaattacatccaggttgggttggtgttttgcaaaagagatacttgtcttcattaggttgtttgtggtttaatagaacacaagctcaagatagaactttagttgcaagaagaatgaaagaacatgttcattctgctgattcaacaccattgttgatcttcccagaaggtacttgtgttaacaacgaatactgtgttatgttcaagagaggtgctttcgatttggatgcaactgtttgtccaatcgctattaaatacaataagatcttcgttgatgcattctggaactctaagtgtcaatctttttcagctcatttggttaagttgatgagatcatgggcattagtttgtgatgtttactttttggaaccacaaactagaagaacaggtgaaacttctcaacaatttgctgaaagagttcaaagaatgatcgctgataaggcaagattgagagttgcaccatgggatggttacttaaagtactacaatttgggtgaaaagcatccagatttgatcgaaaagcaaagaagagttttctctgatgctattaaacaacatgctgatccagcatcaggtggtgaaagaagaagaggtgtcatgtaa

SEQ ID NO: 171 - DNA, 1083 bp, Artificial sequence
  Gene sequence for Arabidopsis thaliana LPAT, codon-optimized for expression in Saccharomyces cerevisiae
atggacgttgcttctgctagatctatctcttctcacccatcttactacggtaagccaatctgttcttctcaatcttctttgatcagaatctctcgtgacaaggtttgttgtttcggtagaatctctaacggtatgacttctttcactacttctttgcacgctgttccatctgaaaagttcatgggtgaaactagaagaactggtatccaatggtctaacagatctttgagacacgacccatacagattcttggacaagaagtctccaagatcttctcaattggctagagacatcactgttagagctgacttgtctggtgctgctactccagactcttctttcccagaaccagaaatcaagttgtcttctcgtttgagaggtatcttcttctgtgttgttgctggtatctctgctactttcttgatcgttttgatgatcatcggtcacccattcgttttgttgttcgacccatacagaagaaagttccaccacttcatcgctaagttgtgggcttctatctctatctacccattctacaagatcaacatcgaaggtttggaaaacttgccatcttctgacactccagctgtttacgtttctaaccaccaatctttcttggacatctacactttgttgtctttgggtaagtctttcaagttcatctctaagactggtatcttcgttatcccaatcatcggttgggctatgtctatgatgggtgttgttccattgaagagaatggacccaagatctcaagttgactgtttgaagagatgtatggaattgttgaagaagggtgcttctgttttcttcttcccagaaggtactagatctaaggacggtagattgggttctttcaagaagggtgctttcactgttgctgctaagactggtgttgctgttgttccaatcactttgatgggtactggtaagatcatgccaactggttctgaaggtatcttgaaccacggtaacgttagagttatcatccacaagccaatccacggttctaaggctgacgttttgtgtaacgaagctagatctaagatcgctgaatctatggacttgcacgacgaattgtaa

SEQ ID NO: 172 - DNA, 864 bp, Artificial sequence
  Gene sequence for Bos taurus AGPAT1, codon-optimized for expression in Saccharomyces cerevisiae
atggaattgtggccaggtgctggtactttgttgttgttgttgttcttgttgttgttgttgttgttgccaactttgtggttctgttctccatctgctaagtacttcttcaagatggctttctacaacggttggatcttgttcttggctgttttggctatcccagtttgtgctgttagaggtagaaacgttgaaaacatgaagatcttgagattgatgttgttgcacatcaagtacttgtacggtatcagagttgaagttagaggtgctcaccacttcccaccatctcaaccatacgttgttgtttctaaccaccaatcttctttggacttgttgggtatgatggaagttttgccaggtagatgtgttccaatcgctaagagagaattgttgtgggctggttctgctggtttggcttgttggttggctggtgttatcttcatcgacagaaagagaactggtgacgctatctctgttatgtctgaagttgctcaaactttgttgactcaagacgttagagtttgggttttcccagaaggtactagaaaccacaacggttctatgttgccattcaagagaggtgctttccacttggctgttcaagctcaagttccaatcgttccaatcgttatgtcttcttaccaagacttctactgtaagaaggaaagaagattcacttctggtagatgtcaagttagagttttgccaccagttccaactgaaggtttgaagccagacgacgttccagctttggctgacagagttagacactctatgttgactgttttcagagaaatctctactgacggtagaggtggtggtgactacttgaagaagccaggtggtgttggtgaagctggtttgtaa

SEQ ID NO: 173 - DNA, 927 bp, Artificial sequence
  Gene sequence for Cocos nucifera LPAAT, codon-optimized for expression in Saccharomyces cerevisiae
atggacgcttctggtgcttcttctttcttgagaggtagatgtttggaatcttgtttcaaggcttctttcggtatgtctcaaccaaaggacgctgctggtcaaccatctcgtagaccagctgacgctgacgacttcgttgacgacgacagatggatcactgttatcttgtctgttgttagaatcgctgcttgtttcttgtctatgatggttactactatcgtttggaacatgatcatgttgatcttgttgccatggccatacgctagaatcagacaaggtaacttgtacggtcacgttactggtagaatgttgatgtggatcttgggtaacccaatcactatcgaaggttctgaattctctaacactagagctatctacatctgtaaccacgcttctttggttgacatcttcttgatcatgtggttgatcccaaagggtactgttactatcgctaagaaggaaatcatctggtacccattgttcggtcaattgtacgttttggctaaccaccaaagaatcgacagatctaacccatctgctgctatcgaatctatcaaggaagttgctagagctgttgttaagaagaacttgtctttgatcatcttcccagaaggtactagatctaagactggtagattgttgccattcaagaagggtttcatccacatcgctttgcaaactagattgccaatcgttccaatggttttgactggtactcacttggcttggagaaagaactctttgagagttagaccagctccaatcactgttaagtacttctctccaatcaagactgacgactgggaagaagaaaagatcaaccactacgttgaaatgatccacgctttgtacgttgaccacttgccagaatctcaaaagccattggtttctaagggtagagacgcttctggtagatctaactcttaa

SEQ ID NO: 174 - DNA, 1086 bp, Artificial sequence
  Gene sequence for Bos taurus DGAT2, codon-optimized for expression in Saccharomyces cerevisiae
atgaagactttgatcgctgcttactctggtgttttgagaggtactggttcttctatcttgtctgctttgcaagacttgttctctgttacttggttgaacagatctaaggttgaaaagcaattgcaagttatctctgttttgcaatgggttttgtctttcttggttttgggtgttgcttgttctgttatcttgatgtacactttctgtactgactgttggttgatcgctgttttgtacttcacttggttggttttcgactggaacactccaaagaagggtggtagaagatctcaatgggttagaaactgggctgtttggagatacttcagagactacttcccaatccaattggttaagactcacaacttgttgacttctcgtaactacatcttcggttaccacccacacggtatcatgggtttgggtgctttctgtaacttctctactgaagctactgaagtttctaagaagttcccaggtatcagaccatacttggctactttggctggtaacttcagaatgccagttttgagagaatacttgatgtctggtggtatctgtccagttaacagagacactatcgactacttgttgtctaagaacggttctggtaacgctatcatcatcgttgttggtggtgctgctgaatctttgtcttctatgccaggtaagaacgctgttactttgagaaacagaaagggtttcgttaagttggctttgagacacggtgctgacttggttccaacttactctttcggtgaaaacgaagtttacaagcaagttatcttcgaagaaggttcttggggtagatgggttcaaaagaagttccaaaagtacatcggtttcgctccatgtatcttccacggtagaggtttgttctcttctgacacttggggtttggttccatactctaagccaatcactactgttgttggtgaaccaatcactatcccaagattggaaagaccaactcaacaagacatcgacttgtaccacgctatgtacgttcaagctttggttaagttgttcgaccaacacaagactaagttcggtttgccagaaactgaagttttggaagttaactaa

The invention claimed is:

1. A fungal cell capable of producing triacylglycerols with fatty acids with an acyl chain having a target characteristic, wherein the fungal cell is genetically modified for expression of a heterologous lysophosphatidyl acyltransferase (LPAT) (EC 2.3.1.51) capable of esterifying a triacylglycerol precursor with an acyl-CoA with an acyl chain having the target characteristic; and the heterologous LPAT has preference for esterifying a triacylglycerol precursor with a saturated fatty acyl-CoA over esterifying a triacylglycerol precursor with an unsaturated fatty acyl-CoA, wherein the heterologous LPAT is selected from the group consisting of Bos taurus AGPAT4 as defined in SEQ ID NO: 13, 14, or 15, Bos taurus AGPAT1 as defined in SEQ ID NO: 16, Bos taurus AGPAT2 as defined in SEQ ID NO: 17, Bos taurus AGPAT3 as defined in SEQ ID NO: 18, Bos taurus AGPAT5 as defined in SEQ ID NO: 19, Arabidopsis thaliana LPAT1 as defined in SEQ ID NO: 20, Brassica napus LPAT1 as defined in SEQ ID NO: 24, Mycolicibacterium smegmatis ERS451418_00313 as defined in SEQ ID NO: 28, Mycolicibacterium smegmatis Probable LPAT as defined in SEQ ID NO: 29, Mycolicibacterium smegmatis ERS451418_06226 as defined in SEQ ID NO: 30, Mycolicibacterium smegmatis ERS451418_02370 as defined in SEQ ID NO: 31, Mycolicibacterium smegmatis ERS451418_05575 as defined in SEQ ID NO: 32, Mycolicibacterium smegmatis ERS451418_04128 as defined in SEQ ID NO: 33, Mycolicibacterium smegmatis ERS451418_06227 as defined in SEQ ID NO: 34, Mycolicibacterium smegmatis BIN_B_00519 as defined in SEQ ID NO: 35, Mycolicibacterium smegmatis D806_035910 as defined in SEQ ID NO: 36, Mycolicibacterium smegmatis BIN_B_03706 as defined in SEQ ID NO: 37 Mycolicibacterium smegmatis D806_003290 as defined in SEQ ID NO: 38, Cocos nucifera probable LPAT as defined in SEQ ID NO: 86, and a heterologous LPAT having at least 95% sequence identity to any of SEQ ID NOs: 13-20, 24, 28-38, or 86.

2. The fungal cell according to claim 1, wherein
the fungal cell is genetically modified for overexpression of a triacylglycerol lipase (EC 3.1.1.3); and
the triacylglycerol lipase has higher lipase activity on unsaturated fatty acids of triacylglycerols compared to saturated fatty acids.

3. The fungal cell according to claim 2, wherein the triacylglycerol lipase is selected from the group consisting of *Homo sapiens* PNLIP as defined in SEQ ID NO: 11, *Yarrowia lipolytica* Lip2 as defined in SEQ ID NO: 12, *Diutina rugosa* LIP1 as defined in SEQ ID NO: 39, *Streptomyces rimosus* CP984 RS32550 as defined in SEQ ID NO: 40, *Geotrichum candidum* LIP1 as defined in SEQ ID NO: 41, *Geotrichum candidum* LIP2 as defined in SEQ ID NO: 42, *Streptomyces coelicolor* LIP1 as defined in SEQ ID NO: 43, *Amycolatopsis mediterranei* AMED 3680 as defined in SEQ ID NO: 45, *Penaeus vannamei* C7M84_014708 as defined in SEQ ID NO: 48, *Solanum lycopersicum* LeLID1 as defined in SEQ ID NO: 50, *Pseudozyma aphidis* LIPA as defined in SEQ ID NO: 51, and a triacylglycerol lipase having at least 70% sequence identity to any of SEQ ID NOs: 11-12, 39-43, 45, 48, or 50-51.

4. The fungal cell according to claim 1, wherein the fungal cell is genetically modified for expression of (a) a heterologous glycerol-3-phosphate acyltransferase (GPAT) selected from the group consisting of *Bos taurus* GPAT4 isoform X1 as defined in SEQ ID NO: 52, *Bos taurus* GPAT4 isoform X2 as defined in SEQ ID NO: 53, *Bos taurus* GPAT2 as defined in SEQ ID NO: 54, *Bos taurus* GPAT3 isoform X1 as defined in SEQ ID NO: 55, *Bos taurus* GPAT3 isoform X2 as defined in SEQ ID NO: 56, *Bos taurus* GPAT3 isoform X3 as defined in SEQ ID NO: 57, *Bos taurus* GPAT3 isoform X4 as defined in SEQ ID NO: 58, *Mus musculus* GPAT4 isoform X1 as defined in SEQ ID NO: 59, *Homo sapiens* GPAM isoform X1 as defined in SEQ ID NO: 60, *Cucurbita moschata* ATS1;2 as defined in SEQ ID NO: 61, *Mus musculus* GPAT2 as defined in SEQ ID NO: 63, and a heterologous GPAT having at least 70% sequence identity to any of SEQ ID NOs: 52-61, or 63; and/or (b) a heterologous diacylglycerol acyltransferase (DGAT) selected from the group consisting of *Brassica napus* DGAT1-1 as defined in SEQ ID NO: 7, *Tropaeolum majus* DGAT as defined in SEQ ID NO: 10, *Bos taurus* DGAT1 isoform X1 as defined in SEQ ID NO: 64, *Bos taurus* DGAT1 isoform X2 as defined in SEQ ID NO: 65, *Bos taurus* DGAT2 as defined in SEQ ID NO: 66, *Bos taurus* DGAT2L6 as defined in SEQ ID NO: 67, *Homo sapiens* DGAT2 as defined in SEQ ID NO: 69, *Arachis hypogaea* DGAT3 as defined in SEQ ID NO: 70, *Arabidposis thaliana* DGAT1 as defined in SEQ ID NO: 71, *Thraustochytrium aureum* DGAT2 as defined in SEQ ID NO: 72, and a heterologous DGAT having at least 70% sequence identity to any of SEQ ID NOs: 7, 10, 64-67, or 69-72.

5. The fungal cell according to claim 1, wherein the fungal cell is genetically modified for:

a) downregulation or deletion of
  i) an endogenous acyl-CoA oxidase;
  ii) an endogenous glycerol-3-phosphate acyltransferase;
  iii) an endogenous lysophosphatidyl acyltransferase;
  iv) an endogenous diacylglycerol acyltransferase;
  v) an endogenous desaturase; and/or
  vi) an endogenous lipase; and/or
b) enhanced activity of an acetyl-CoA carboxylase.

6. A method for producing triacylglycerols comprising:
culturing a fungal cell according to claim 1 in a culture medium and in culture conditions suitable for production of the triacyclglycerols by the fungal cell, preferably nitrogen-limited conditions; and
collecting the triacyclglycerols from the culture medium and/or the fungal cell.

\* \* \* \* \*